(12) United States Patent
Korber et al.

(10) Patent No.: US 7,951,377 B2
(45) Date of Patent: May 31, 2011

(54) MOSAIC CLADE M HUMAN IMMUNODEFICIENCY VIRUS TYPE 1 (HIV-1) ENVELOPE IMMUNOGENS

(75) Inventors: Bette T. Korber, Los Alamos, NM (US); William Fischer, Los Alamos, NM (US); Hua-Xin Liao, Durham, NC (US); Barton F. Haynes, Durham, NC (US); Norman Letvin, Boston, MA (US); Beatrice H. Hahn, Birmingham, AL (US)

(73) Assignees: Los Alamos National Security, LLC, Los Alamos, NM (US); Duke University, Durham, NC (US); Beth Isreal Deaconess Medical Center, Boston, MA (US); The University of Albama at Birmingham Research Foundation, Birmingham, AL (US)

( * ) Notice: Subject to any disclaimer, the term of this patent is extended or adjusted under 35 U.S.C. 154(b) by 47 days.

(21) Appl. No.: 12/192,015

(22) Filed: Aug. 14, 2008

(65) Prior Publication Data

US 2009/0198042 A1    Aug. 6, 2009

Related U.S. Application Data

(63) Continuation-in-part of application No. 11/990,222, filed as application No. PCT/US2006/032907 on Aug. 23, 2006.

(60) Provisional application No. 60/710,154, filed on Aug. 23, 2005, provisional application No. 60/739,413, filed on Nov. 25, 2005.

(51) Int. Cl.
*A61K 39/21*    (2006.01)

(52) U.S. Cl. .................................. 424/188.1; 424/208.1

(58) Field of Classification Search .................... None
See application file for complete search history.

(56) References Cited

U.S. PATENT DOCUMENTS

| | | | |
|---|---|---|---|
| 2002/0198162 | A1 | 12/2002 | Punnonen et al. |
| 2003/0044421 | A1 | 3/2003 | Emini et al. |
| 2003/0104011 | A1 | 6/2003 | Rios |
| 2003/0147888 | A1 | 8/2003 | Haynes et al. |
| 2003/0180314 | A1 | 9/2003 | DeGroot |
| 2003/0194411 | A1 | 10/2003 | Rubinstein et al. |
| 2006/0216305 | A1 | 9/2006 | Lal et al. |
| 2006/0275897 | A1 | 12/2006 | Nabel et al. |

FOREIGN PATENT DOCUMENTS

| | | |
|---|---|---|
| WO | WO 2007/024941 | 3/2007 |
| WO | WO 2007/047916 | 4/2007 |

OTHER PUBLICATIONS

International Search Report dated Aug. 27, 2008—International Appln. No. PCT/US06/32907.
Shinoda et al, "Polygene DNA vaccine induces a high level of protective effect against HIV-vaccinia virus challenge in mice", Vaccine 22:3676-3690 (2004).
International Search Report dated Apr. 6, 2010—International Appln. No. PCT/US2009/004664.
Office Action dated Jun. 4, 2010 issued in connection with U.S. Appl. No. 11/990,222.

*Primary Examiner* — Jeffrey S Parkin
(74) *Attorney, Agent, or Firm* — Nixon & Vanderhye P.C.

(57) ABSTRACT

The present invention relates to mosaic clade M HIV-1 Env polypeptides and to compositions comprising same. The polypeptides of the invention are suitable for use in inducing an immune response to HIV-1 in a human.

6 Claims, 109 Drawing Sheets

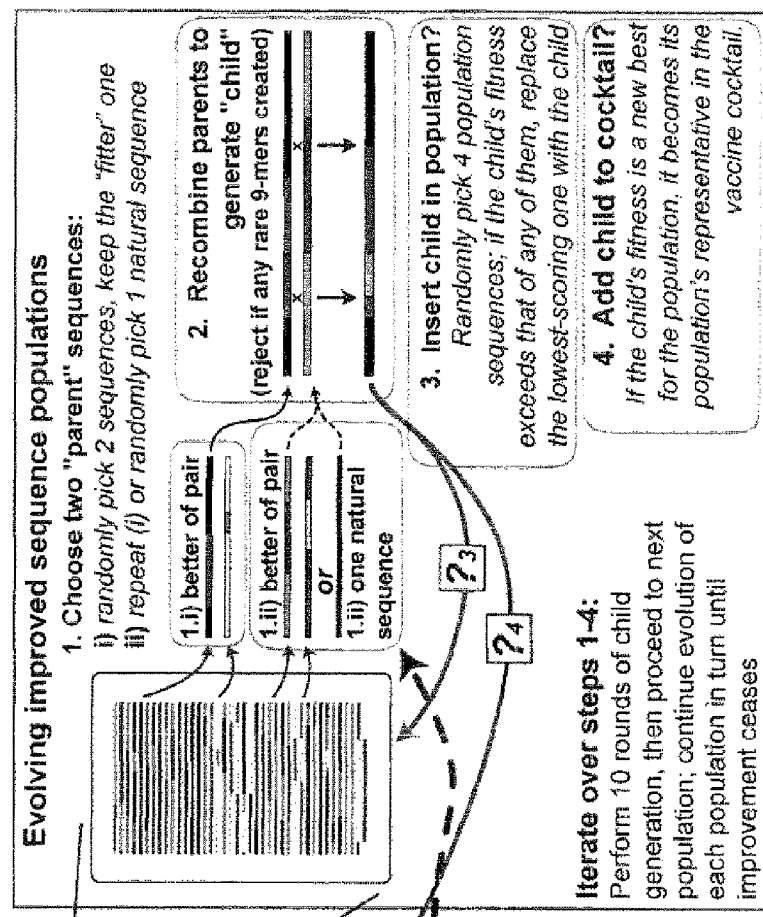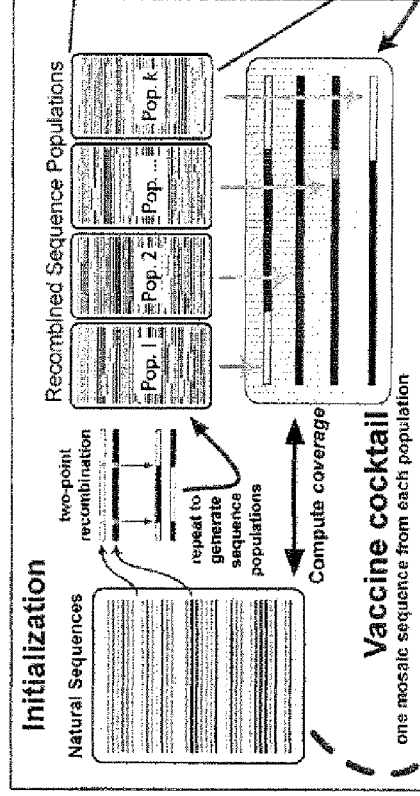
Fig. 2A
Fig. 2B
Fig. 2C

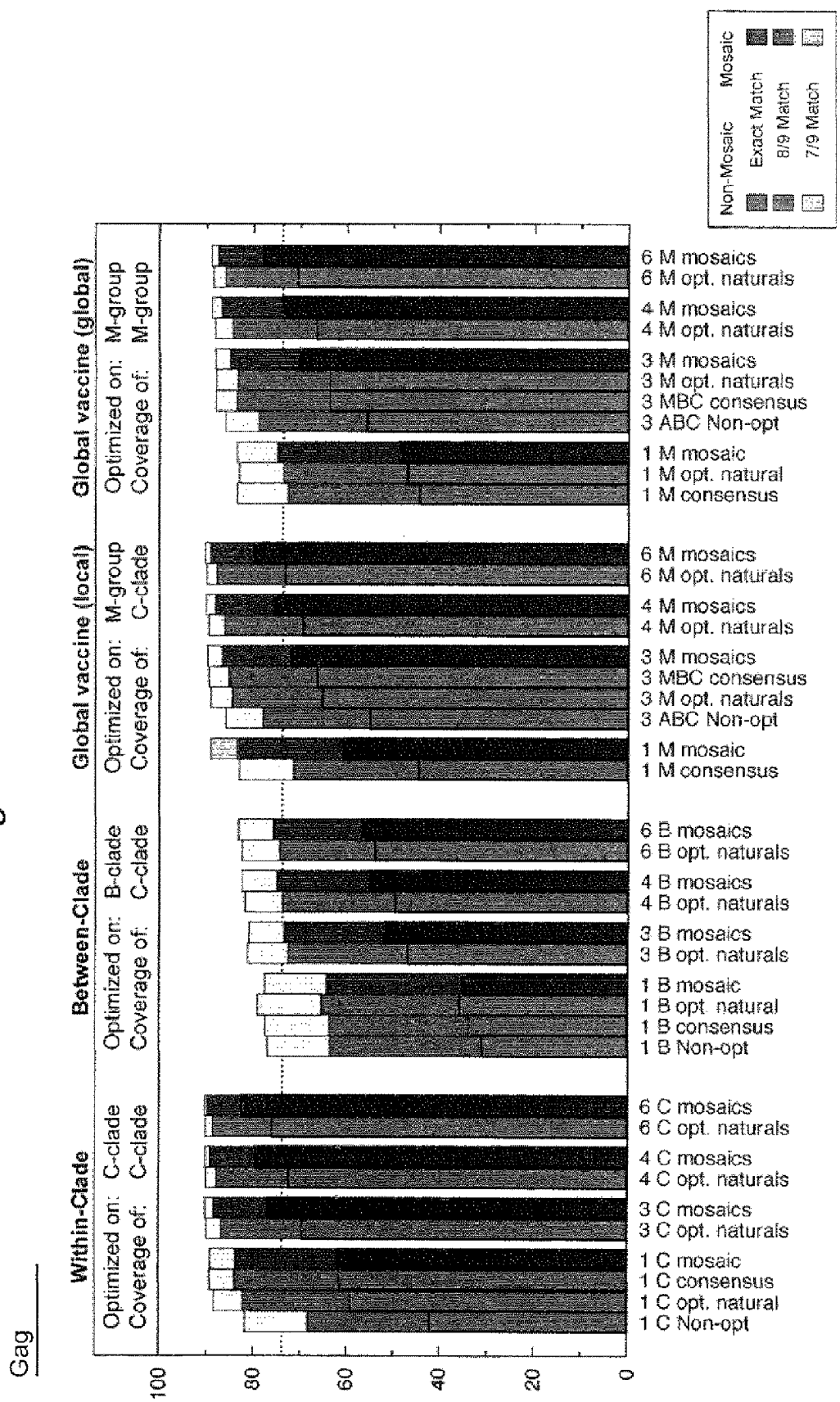

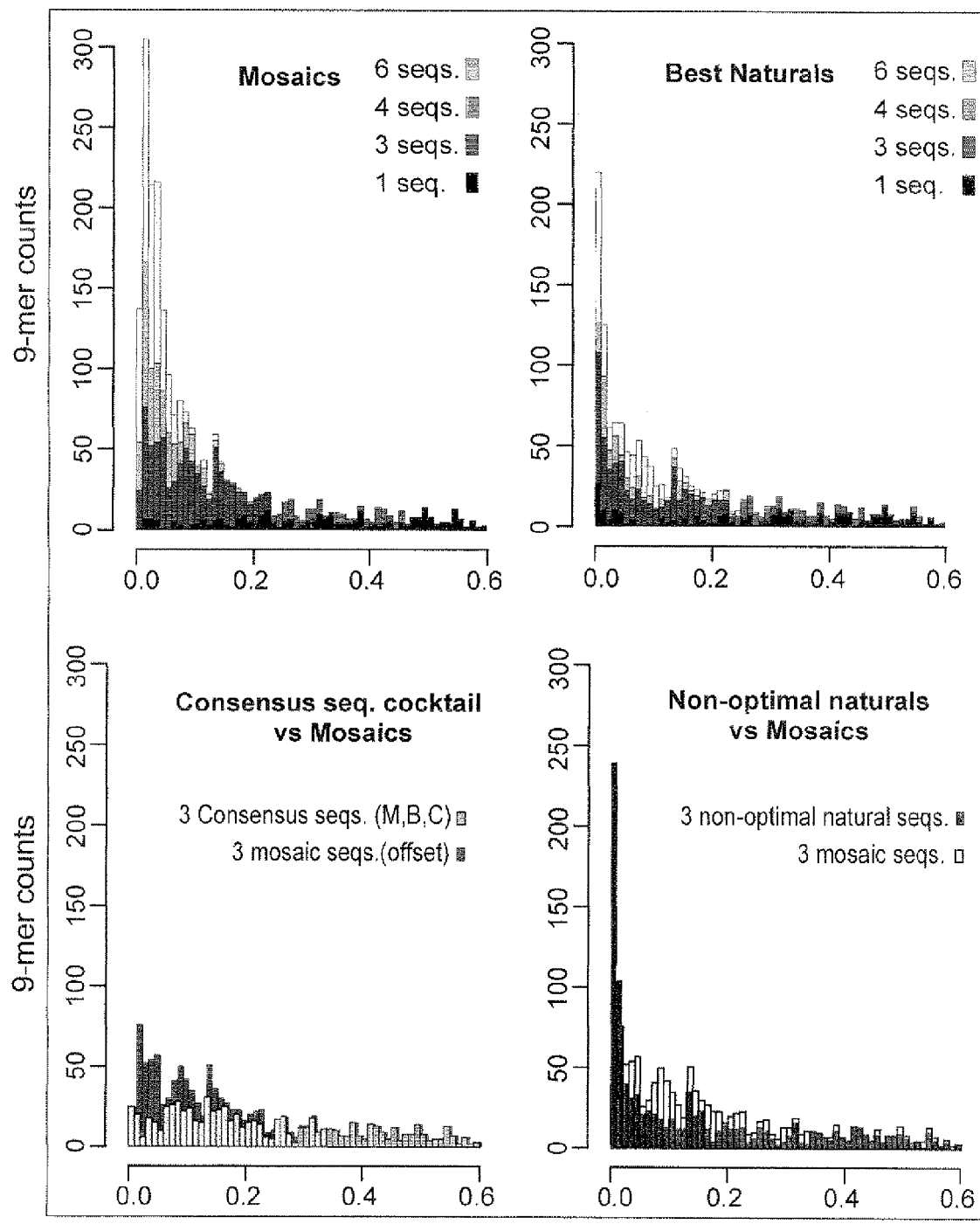

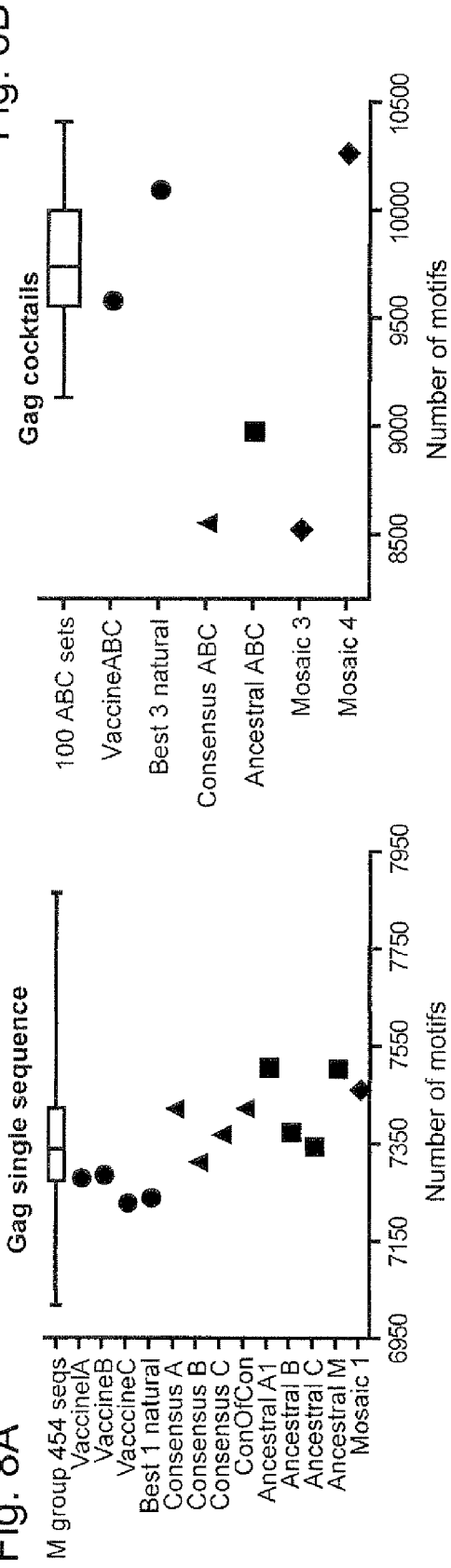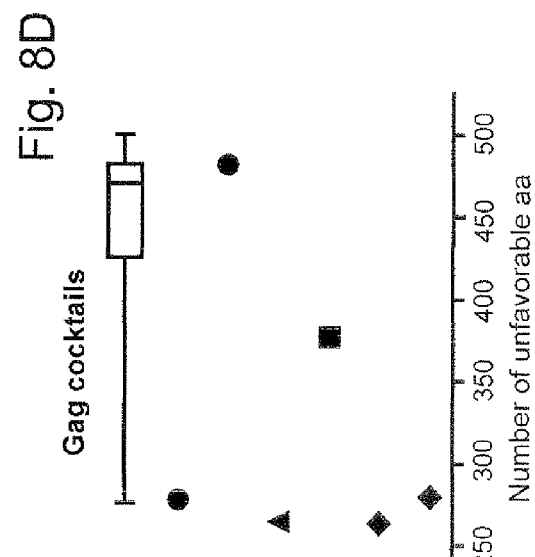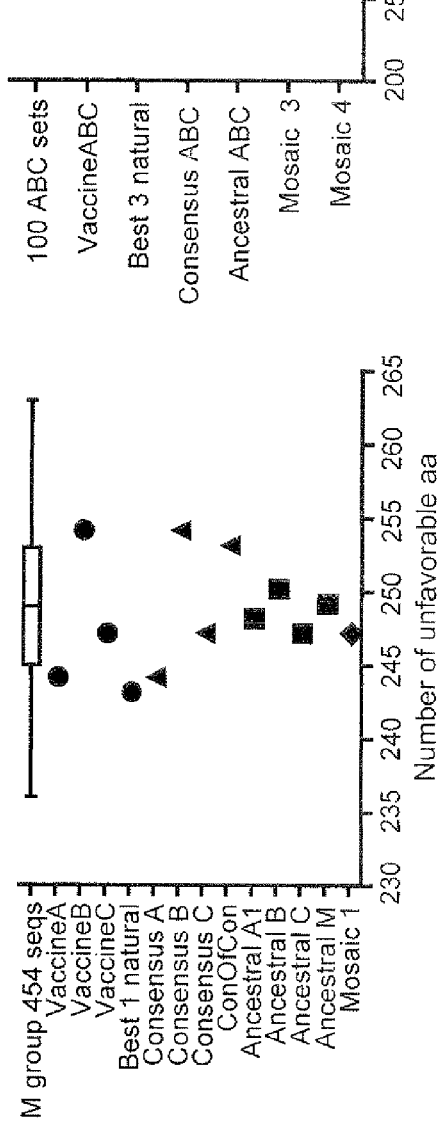

Fig. 9

>nef_coreB.syn1.1
EVGFPVRPQVPLRPMTYKGALDLSHFLKEKGGLEGLIYSQKRQDILDLWVYHTQGYFPDW
QNYTPGPGIRYPLTFGWCFKLVPVE >nef_coreB.syn3.1
EVGFPVKPQVPLRPMTYKAAVDLSHFLKEKGGLEGLVYSQKRQDILDLWIYHTQGYFPDW
QNYTPGPGTRFPLTFGWCFKLVPVD
>nef_coreB.syn3.2
EVGFPVTPQVPLRPMTYKGALDLSHFLREKGGLEGLIYSQKRQEILDLWVYHTQGYFPDW
HNYTPGPGVRYPLTFGWCFKLVPVE
>nef_coreB.syn3.3
EVGFPVRPQVPLRPMTYKAALDLSHFLKEKGGLEGLIHSQRRQDILDLWVYHTQGFFPDW
QNYTPGPGIRYPLTFGWCYKLVPVE >nef_coreB.syn4.1
EVGFPVTPQVPLRPMTYKAAVDLSHFLREKGGLEGLIHSQKRQDILDLWIYHTQGYFPDW
QNYTPGPGIRYPLTFGWCYKLVPVE
>nef_coreB.syn4.2
DVGFPVRPQIPLRPMTYKAALDLSHFLREKGGLEGLVYSQKRQDILDLWVYHTQGFFPDW
QNYTPGPGTRFPLTFGWCFKLVPVD
>nef_coreB.syn4.3
EVGFPVRPQVPLRPMTYKGAVDLSHFLKEKGGLEGLIYSQKRQEILDLWVYHTQGYFPDW
GNYTPGPGTRYPLTFGWCLKLVPVE
>nef_coreB.syn4.4
EVGFPVKPQVPLRPMTYKGALDLSHFLKEKGGLDGLIYSQRRQDILDLWVYNTQGYFPDW
HNYTPGPGVRYPLTFGWCFKLVPVE >nef_coreB.syn6.1
EVGFPIRPQVPLRPMTFKGALDLSHFLKEKGGLDGLIYSQKRQEILDLWVYHTQGYFPDW
HNYTPGPGIRYPLCFGWCFKLVPVE
>nef_coreB.syn6.2
EVGFPVTPQVPLRPMTYKGAVDLSHFLKEQGGLEGLIYSQRRQDILDLWIYNTQGYFPDW
QCYTPGPGVRFPLTFGWCFKLEPVD
>nef_coreB.syn6.3
EVGFPVKPQVPLRPMTYKAAVDLSHFLKEKGGLEGLIYSQKRQDILDLWIYHTQGYFPDW
QNYTPGPGIRYPLTFGWCLKLVPVE
>nef_coreB.syn6.4
DVGFPVRPQVPLRPMTYKAALDLSHFLKEEGGLEGLIYSQQRQDILDLWVYHTQGFFPDW
QNYTPGPGTRYPLTFGWCYKLVPVE
>nef_coreB.syn6.5
EVGFPVRPQIPLRPMTYKGALDLSHFLREKGGLEGLVYSQKRQDILDLWVHHTQGYFPDW
GNYTPGPGTRFPLTFGWCFKLVPVD
>nef_coreB.syn6.6
EVGFPVRPQVPLRPMTYKGAFDLSHFLKDKGGLEGLIHSQKRQDILDLWVYNTQGYFPDW
QNYTPGPGVRYPLTFGWCFKLVPLE >nef_coreC.syn1.1
EVGFPVRPQVPLRPMTYKAAFDLSFFLKEKGGLEGLIYSKKRQEILDLWVYHTQGFFPDW
QNYTPGPGVRYPLTFGWCFKLVPVD

Fig. 9 cont'd-1

```
>nef_coreC.syn3.1
EVGFPVTPQVPLRPMTFKGAFDLGFFLKEKGGLDGLIYSKKRQDILDLWVYHTQGYFPDW
QNYTPGPGVRYPLTFGWCYKLVPVD
>nef_coreC.syn3.2
EVGFPVKPQVPLRPMTYKAAFDLSFFLKDKGGLEGLIWSKKRQEILDLWVYHTQGFFPDW
QNYTPGPGIRYPLTFGWPFKLVPVD
>nef_coreC.syn3.3
EVGFPVRPQVPLRPMTYKGAFDLSFFLKEKGGLEGLIYSKKRQEILDLWVYNTQGFFPDW
HNYTPGPGVRFPLTFGWCFKLVPVD >nef_coreC.syn4.1
EVGFPVRPQVPLRPMTYKGAFDLSFFLKEKGGLEGLIWSKKRQEILDLWVYNTQGYFPDW
QCYTPGPGVRFPLTFGWCFKLVPVD
>nef_coreC.syn4.2
DVGFPVRPQVPVRPMTYKAAFDLSFFLKDKGGLEGLIHSKRRQDILDLWVYNTQGFFPDW
HNYTPGPGIRYPLTFGWCFKLVPVD
>nef_coreC.syn4.3
EVGFPVKPQVPLRPMTYKAAVDLSFFLKEKGGLEGLIYSKKRQEILDLWVYHTQGFFPDW
QNYTPGPGTRYPLTFGWPFKLVPVD
>nef_coreC.syn4.4
EVGFPVTPQVPLRPMTFKGAFDLGFFLKEKGGLDGLIYSKKRQDILDLWVYHTQGYFPDW
QNYTPGPGVRYPLTFGWCYKLVPVD >nef_coreC.syn6.1
DVGFPVRPQVPLRPMTYKGAFDLSFFLKEKGGLDGLIYSKKRQEILDLWVYNTQGYFPDW
QCYTPGPGVRYPLTFGWCYKLVPVD
>nef_coreC.syn6.2
EVGFPVKPQVPVRPMTYKAAFDLSFFLKDKGGLEGLIWSKKRQEILDLWVYHTQGFFPDW
QNYTPGPGIRYPLTFGWCFKLVPVD
>nef_coreC.syn6.3
EVGFPVKPQVPLRPMTFKGAFDLGFFLKEKGGLEGLIYSKQRQDILDLWVYHTQGFFPDW
HNYTPGPGVRLPLTFGWCFKLVPVD
>nef_coreC.syn6.4
GVGFPVRPQVPVRPMTYKAAFDLGFFLKDKGGLEGLIYSKKRQDILDLWVYNTQGFFPDW
QNYTPGPGVRFPLTFGWCFKLVPVD
>nef_coreC.syn6.5
EVGFPVTPQVPLRPMTYKAAVDLSWFLKEKGGLDGLIYSRKRQEILDLWVHHTQGFFPDW
QNYTPGPGTRFPLTFGWCFKLVPVD
>nef_coreC.syn6.6
EVGFPVRPQVPVRPMTYKGAVDLSFFLKEKGGLEGLIHSKRRQDILDLWVYHTQGYFPDW
QNYTPGPGTRYPLTFCWPFKLVPVD >nef_coreM.syn1.1
EVGFPVRPQVPLRPMTYKGALDLSHFLKEKGGLEGLIYSKKRQEILDLWVYHTQGYFPDW
QNYTPGPGVRYPLTFGWCFKLVPVD
```

Fig. 9 cont'd-2

>nef_coreM.syn3.1
DVGFPVRPQVPLRPMTYKAAVDLSHFLKEKGGLEGLVYSQKRQDILDLWVYHTQGFFPDW
QNYTPGPGVRYPLTFGWCYKLVPVD
>nef_coreM.syn3.2
EVGFPVRPQVPVRPMTYKGAFDLSFFLKEKGGLEGLIYSKKRQEILDLWVYHTQGYFPDW
HNYTPGPGTRFPLTFGWCFKLVPVD
>nef_coreM.syn3.3
EVGFPVKPQVPLRPMTYKGALDLSHFLKEKGGLDGLIYSKKRQDILDLWVYNTQGYFPDW
QNYTPGPGIRYPLTFGWCFKLVPVE >nef_coreM.syn4.1
EVGFPVTPQVPLRPMTFKGAFDLGFFLKEKGGLEGLIYSKKRQEILDLWVYHTQGFFPDW
QNYTPGPGTRYPLCFGWCFKLVPVE
>nef_coreM.syn4.2
EVGFPVKPQVPLRPMTYKAAVDLSHFLKEKGGLEGLVYSQKRQDILDLWVYHTQGYFPDW
QNYTPGPGIRYPLTFGWCYKLVPVD
>nef_coreM.syn4.3

DVGFPVRPQVPLRPMTYKGALDLSHFLKEEGGLEGLIYSQKRQEILDLWVYNTQGYFPDW
QNYTPGPGVRYPLTFGWCFKLVPVD
>nef_coreM.syn4.4
EVGFPVRPQVPVRPMTYKGAFDLSFFLKEKGGLDGLIYSKKRQDILDLWVYNTQGFFPDW
HNYTPGPGTRFPLTFGWCFELVPVD >nef_coreM.syn6.1
EVGFPVRPQVPTRPMTYKGAVDLSHFLKEKGGLEGLVYSQKRQDILDLWVHHTQGFFPDW
QNYTPGPGTRYPLTFGWPFKLVPVD
>nef_coreM.syn6.2
DVGFPVRPQVPVRPMTYKAAFDLSFFLREKGGLDGLIYSKKRQDILDLWVYNTQGYFPDW
QNYTPGPGVRFPLTFGWCFELVPVD
>nef_coreM.syn6.3
NVGFPVRPQVPLRPMTFKGAFDLGFFLKEKGGLEGLIYSKKRQEILDLWVYHTQGYFPDW
HNYTPGPGTRFPLTFGWCFKLVPVE
>nef_coreM.syn6.4
EVGFPVTPQVPLRPMTYKGAFDLSFFLKEKGGLDGLIYSRKRQEILDLWVYNTQGFFPDW
QNYTPGPGIRYPLTFGWCFKLVPMD
>nef_coreM.syn6.5
EVGFPVKPQVPLRPMTYKAAVDLSHFLREKGGLEGLIHSQRRQDILDLWIYHTQGYFPDW
QCYTPGPGVRYPLTFGWCYKLVPVD
>nef_coreM.syn6.6
GVGFPVRPQIPLRPMTYKGALDLSHFLKEEGGLEGLIYSQKRQDILDLWVYHTQGFFPDW
HNYTPGPGIRYPLCFGWCFKLVPVD

Fig. 9 cont'd-3

```
>gagB.syn1.1
MGARASVLSGGELDRWEKIRLRPGGKKKYKLKHIVWASRELERFAVNPGLLETSEGCRQI
LGQLQPSLQTGSEELRSLYNTVATLYCVHQRIEVKDTKEALDKIEEEQNKSKKKAQQAAA
DTGNSSQVSQNYPIVQNLQGQMVHQAISPRTLNAWVKVVEEKAFSPEVIPMFSALSEGAT
PQDLNTMLNTVGGHQAAMQMLKETINEEAAEWDRLHPVHAGPIAPGQMREPRGSDIAGTT
STLQEQIGWMTNNPPIPVGEIYKRWIILGLNKIVRMYSPTSILDIRQGPKEPFRDYVDRF
YKTLRAEQASQEVKNWMTETLLVQNANPDCKTILKALGPAATLEEMMTACQGVGGPGHKA
RVLAEAMSQVTNSATIMMQRGNFRNQRKTVKCFNCGKEGHIAKNCRAPRKKGCWKCGKEG
HQMKDC-TERQANFLGKIWPSHKG-RPGNFLQSRP------------------EPTAP
PEESFRFGEETTTPSQKQEPIDKELYPLASLRSLFGNDPSSQ >gagB.syn3.1
MGARASILSGGELDRWEKIRLRPGGKKQYRLKHIVWASRELERFAINPGLLETSDGCRQI
LGQLQPALQTGSEELKSLFNTVATLYCVHQRIDVKDTKEALDKIEEEQNKSKKKAQQAAA
DTGNSSQVSQNYPIVQNIQGQMVHQAISPRTLNAWVKVIEEKAFSPEVIPMFSALSEGAT
PQDLNTMLNTVGGHQAAMQMLKETINEEAADWDRLHPVHAGPIAPGQMREPRGSDIAGTT
STLQEQIGWMTNNPPIPVGEIYKRWIIMGLNKIVRMYSPSSILDIKQGPKEPFRDYVDRF
YKVLRAEQASQEVKNWMTETLLVQNSNPDCKTILKALGPATLEEMMTACQGVGGPGHKA
RVLAEAMSQMTNSATIMMQKGNFRNQRKPVKCFNCGKEGHIAKNCRAPRKKGCWKCGREG
HQMKDC-TERQANFLGKIWPSYKG-RPGNFLQNRP------------------EPTAP
PAESFRFGEETTTPSQKQETIDKELYPLASLRSLFGSDPSSQ >gagB.syn3.2
MGARASVLSGGQLDRWEKIRLRPGGKKKYRLKHLVWASRELERFAVNPGLLETAEGCRQI
LEQLQPSLQTGSEELRSLFNTVAVLYCVHQRIEVKDTKEALDKVEEEQNKSKKKAQQTAA
DTGNNSQVSQNYPIVQNMQGQMVHQALSPRTLNAWVKVIEEKAFSPEVIPMFTALSEGAT
PQDLNTMLNTVGGHQAAMQMLKDTINEEAAEWDRLHPVQAGPVAPGQIREPRGSDIAGST
STLQEQIGWMTSNPPIPVGEIYKRWIILGLNKIVRMYSPVSILDIRQGPKEPFRDYVDRF
YKTLRAEQATQEVKNWMTETLLVQNANPDCKTILKALGPATLEEMMTACQGVGGPSHKA
RVLAEAMSQVTNSATIMMQRGNFRNQRKIVKCFNCGKEGHIARNCRAPRKRGCWKCGKEG
HQMKDC-NERQANFLGKIWPSHKG-RPGNFLQSRP------------------EPSAP
PEESFRFGEEKTTPSQKQEPIDKDLYPLASLKSLFGNDPSLQ >gagB.syn3.3
MGARASVLSGGELDKWEKIRLRPGGKKKYKLKHIVWASRELERFAVNPGLLETSEGCRQI
LGQLQPSLQTGSEELRSLYNTVATLYCVHQKIEVKDTKEALEKIEEEQNKCKKKAQQAAA
GTGNSSQVSQNYPIVQNLQGQMVHQPISPRTLNAWVKVVEEKAFSPEVIPMFSALAEGAT
PQDLNTMLNTVGGHQAAMQMLKETINEEAAEWDRLHPVHAGPVAPGQMRDPRGSDIAGTT
SNLQEQIGWMTHNPPIPVGDIYKRWIILGLNKIVRMYSPTSILDIRQGPKESFRDYVDRF
YKTLRAEQASQDVKNWMTETLLVQNANPDCRTILKALGPAATLEEMMTACQGVGGPSHKA
RILAEAMSQVTNPATIMMQRGNFRNQRKTVKCFNCGKEGHLARNCRAPRKKGCWKCGKEG
HQMKEC-TERQANFLGKIWPSHKG-RPGNFLQSRP------------------EPTAP
PEESFRFGEETATPPQKQEPIDKELYPLTSLRSLFGNDPSSQ >gagB.syn4.1
MGARASVLSGGQLDRWEKIRLRPGGKKKYRLKHLVWASRELERFAVNPGLLETAEGCRQI
LEQLQPSLQTGSEELRSLFNTVATLYCVHQRIDVKDTKEALDKIEEEQNKCKKKAQQAAA
DTGNSSQVSQNYPIVQNIQGQMVHQALSPRTLNAWVKVVEEKAFSPEVIPMFTALSEGAT
PQDLNTMLNTVGGHQAAMQMLKETINEEAAEWDRLHPVQAGPVAPGQMREPRGSDIAGST
STLQEQIGWMTNNPPIPVGDIYKRWIILGLNKIVRMYSPVSILDIRQGPKESFRDYVDRF
YKVLRAEQASQEVKNWMTETLLVQNANPDCRTILKALGPAATLEEMMTACQGVGGPGHKA
```

Fig. 9 cont'd-4

```
RVLAEAMSQMTNSATIMMQRGNFRNQRKTVKCFNCGKEGHIAKNCRAPRKKGCWKCGKEG
HQMKEC-TERQANFLGKIWPSYKG-RPGNFLQSRP------------------EPSAP
PAESFRFGEETTTPSQKQETIDKELYPLTSLRSLFGNDPSLQ
>gagB.syn4.2
MGARASVLSGGELDKWEKIRLRPGGKKKYKLKHIVWASRELERFAINPGLLETSEGCRQI
LGQLQPALQTGSEELRSLYNTVATLYCVHQKIEVKDTKEALEKVEEEQNKSKQKAQQAAA
DTGNNSQVSQNYPIVQNLQGQMVHQAISPRTLNAWVKVIEEKAFSPEVIPMFAALSEGAT
PQDLNTMLNTVGGHQAAMQMLKETINEEAADWDRLHPVHAGPIAPGQIREPRGSDIAGTT
SNLQEQIAWMTNNPPIPVGEIYKRWIIMGLNKIVRMYSPTSILDIKQGPKEPFRDYVDRF
YRTLRAEQASQDVKNWMTETLLVQNANPDCRTILKALGPGATLEEMMTACQGVGGPSHKA
RVLAEAMSQVTNPATIMMQRGNFRNQRKPVKCFNCGKEGHLAKNCRAPRKRGCWKCGKEG
HQMKDC-NERQANFLGKIWPSHKG-RPGNFLQNRP------------------EPSAP
PEESFRFGEETATPSQKQEPIDKELYPLASLRSLFGSDPSSQ
>gagB.syn4.3
MGARASILSGGELDRWEKIRLRPGGKKQYRLKHIVWASRELERFAVNPGLLETSEGCKQI
LEQLQPALQTGSEELKSLYNTVAVLYCVHQRIEIKDTKEALEKIEEEQNKSKKKAQQTAA
DTGNNSQVSQNYPIVQNLQGQMVHQPISPRTLNAWVKVIEEKAFSPEVIPMFSALAEGAT
PQDLNTMLNTVGGHQAAMQMLKETINEEAAEWDRLHPVHAGPVAPGQMRDPRGSDIAGTT
SNLQEQIGWMTSNPPIPVGEIYKRWIILGLNKIVRMYSPTSILDIRQGPKEPFRDYVDRF
YKTLRAEQATQEVKNWMTETLLVQNANPDCKTILKALGPGATLEEMMTACQGVGGPSHKA
RILAEAMSQVTNSATVMMQRGNFRNQRKTIKCFNCGKEGHLARNCRAPRKKGCWKCGREG
HQMKDC-TERQANFLGKIWPSYKG-RPGNFLQNRP------------------EPTAP
PAESFRFGEETTTPPQKQEPIDKELYPLASLKSLFGNDPSSQ
>gagB.syn4.4
MGARASVLSGGKLDKWEKIRLRPGGKKKYQLKHIVWASRELERFALNPGLLETSDGCRQI
LGQLQPSLQTGSEELKSLFNTVAVLYCVHQRIEVKDTKEALDKVEEEQNKSKKKAQQAAA
GTGNSSQVSQNYPIVQNMQGQMVHQALSPRTLNAWVKVIEEKAFSPEVTPMFSALSEGAT
PQDLNTMLNTVGGHQAAMQMLKDTTNEEAAEWDRVHPVHAGPIAPGQMREPRGSDIAGTT
STLQEQIGWMTHNPPIPVGEIYKRWIILGLNKIVRMYSPSSILDIRQGPKEPFRDYVDRF
YKTLRAEQASQEVKNWMTETLLVQNSNPDCKTILKALGPAATLEEMMTACQGVGGPSHKA
RVLAEAMSQVTNSATIMMQKGNFRNQRKIVKCFNCGKEGHIARNCRAPRKKGCWRCGKEG
HQMKDC-TERQVNFLGKIWPSYKG-RPGNFLQSRP------------------EPTAP
PEESFRFGEEKTTPSQKQEPIDKDLYPLASLKSLFGNDPLSQ >gagB.syn6.1
MGARASILSGGELDRWEKIRLRPGGSKKYRLKHIVWASRELERFAVNPGLLETAEGCRQI
LGQLQPSLQTGSEELRSLYNTIATLYCVHQRIEIKDTKEALEKIEEEQNKSKKKAQQTAA
DTGNNSQVSQNYPIVQNLQGQMVHQPISPRTLNAWVKVVEEKAFSPEVIPMFSALAEGAT
PQDLNTMLNTVGGHQAAMQMLKETINEEAAEWDRLHPVHAGPVAPGQIREPRGSDIAGTT
SNLQEQIGWMTSNPPIPVGEIYKRWIILGLNKIVRMYSPISILDIRQGPKEPFRDYVDRF
YRTLRAEQASQDVKNWMTETLLVQNANPDCKTILKALGPGATLEEMMTACQGVGGPGHKA
RVLAEAMSQVTNSATVMMQRGNFRNQRRTVKCFNCGKEGHIARNCRAPRKKGCWKCGQEG
HQMKDC-TERQANFLGKIWPSYKG-RPGNFLQSRP------------------EPTAP
PAESFRFGEETTTPPQKQEPIDKELYPLTSLKSLFGNDPSSQ
>gagB.syn6.2
MGARASVLSGGKLDRWEKIRLRPGGKKKYRLKHVVWASRELERFAVNPGLLESSEGCRQI
LEQLQPSLQTGSEELRSLFNTVATLYCVHQRIDVKDTKEALDKIEEEQNKCKKKAQQAAA
DTGNNSQVSQNYPIVQNLQGQMVHQPISPRTLNAWVKVVEEKAFSPEVIPMFAALSEGAT
PQDLNTMLNTVGGHQAAMQMLKETINEEAAEWDRVHPVHAGPIAPGQMREPRGSDIAGST
STLQEQIGWMTNNPPIPVGDIYKRWIILGLNKIVRMYSPASILDIRQGPKEPFRDYVDRF
YKTLRAEQATQEVKNWMTETLLVQNANPDCRTILKALGPGATLEEMMTACQGVGGPGHKA
RVLAEAMSQMTNSATIMMQKGNFRNQRKTIKCFNCGKEGHIARNCKAPRKKGCWKCGREG
HQMKDC-IERQANFLGKTWPSHKG-RPGNFLQNRP------------------EPTAP
PEESFRFGEETATPPQKQEPIDKELYPLASLKSLFGSDPSSQ
```

Fig. 9 cont'd-5

```
>gagB.syn6.3
MGARASVLSGGELDRWEKIRLRPGGKKKYRLKHLVWASRELERFAVNPGLLETSDGCRQI
LGQLQPALQTGSEELKSLYNTVATLYCVHQKIDVRDTKEALDKIEEEQNKSKQKAQQAAA
DTGNSSQVSQNYPIVQNIQGCMVHQAISPRTLNAWVKVVEEKAFSPEVIPMFTALSEGAT
PQDLNTMLNTVGGHQAAMQMLKETINEEAAEWDRLHPVQAGPVAPGQMREPRGSDIAGTT
STLQEQIGWMTHNPPIPVGEIYKRWIIMGLNKIVRMYSPSSILDIRQGPKESFRDYVDRF
YKVLRAEQASQEVKNWMTETLLVQNANPDCKTILKALGPGATLEEMMTACQGVGGPSHKA
RVLAEAMSQVTNSATIMMQRGNFRNQRKTVKCFNCGKEGHIAKNCRAPRKRGCWKCGKEG
HQMKEC-TERQANFLGKIWPSHKG-RPGNFLQSRP------------------EPTAP
PEESFRFGEEKTTPSCKQETIDKELYPLASLRSLFGNDPSSQ
>gagB.syn6.4
MGARASVLSGGELDKWEKIRLRPGGKKKYQLKHIVWASRELERFAVNPGLLETSEGCKQI
LEQLQPALQTGSEELRSLYNTIAVLYCVHQKIEIKDTKEALDKVEEEQNKSKKKAQQAAA
GTGNSSQVSQNYPIVQNLQGCMVHQPLSPRTLNAWVKVVEEKAFSPEVIPMFTALSEGAT
PQDLNTMLNTVGGHQAAMQMLKETINEEAADWDRLHPVHAGPIAPGQMREPRCSDIAGST
STLQEQIGWMTHNPPIPVGDIYKRWIILGLNKIVRMYSPTSILDIKQGPKEPFRDYVDRF
YKTLRAEQATQEVKNWMTETLLVQNANPDCRTILKALGPAATLEEMMTACQGVGGPSHKA
RILAEAMSQVTNPATIMMQRGNFRNQRKPVKCFNCGKEGHIARNCRAPRKRGCWKCGKEG
HQMKDC-TERQVNFLGKIWPSHKG-RPGNFLQNRP------------------EPSAP
PAESFRFGEETTTPSCKQEPIDKEMYPLASLRSLFGSDPSSQ
>gagB.syn6.5
MGARASVLSGGQLDRWEKIRLRPGGKKQYRLKHIVWASRELERFAINPGLLETSEGCRQI
LGQLQPSLQTGSEELKSLFNTVAVLYCVHQRIEVKDTKEALEKVEEEQNKSKKKAQQAAA
DTGNSSQVSQNYPIVQNLQGCMVHQALSPRTLNAWVKVIEEKAFSPEVIPMFSALSEGAT
PQDLNTMLNTVGGHQAAMQMLKDTINEEAAEWDRLHPVHAGPVAPGQMRDPRGSDIAGTT
STLQEQIAWMTNNPPIPVGEIYKRWIILGLNKIVRMYSPTSILDIRQGPKEPFRDYVDRF
YKVLRAEQASQDVKNWMTETLLVQNANPDCKTILKALGPAATLEEMMTACQGVGGPGHKA
RVLAEAMSQVTNSTTIMMQRGNFRNQRKIVKCFNCGKEGHLAKNCRAPRKKGCWKCGKEG
HQMKEC-TERQANFLGKIWPSHKG-RPGNFLQSRP------------------EPSAP
PEESFRFGEETATPSCKQEPIDKDLYPLASLKSLFGNDPLSQ
>gagB.syn6.6
MGARASVLSGGKLDKWEKIRLRPGGKKKYKLKHIVWASRELERFALNPGLLETSEGCRQI
LRQLQPSLQTGSEELRSLYNTVATLYCVHQKIEVKDTKEALEKIEEEQNKSKKKAQQTAA
DTGNNSQVSQNYPIVQNMQGCMVHQALSPRTLNAWVKVVEEKAFSPEVIPMFSALSEGAT
PQDLNTMLNTVGGHQAAMQMLKDTINEEAAEWDRLHPAQAGPIAPGQIREPRGSDIAGTT
SNLQEQIAWMTHNPPIPVGDIYKRWIILGLNKIVRMYSPVSILDIRQGPKEPFRDYVDRF
YKTLRAEQASQEVKNWMTETLLVQNSNPDCKTILKALGPGATLEEMMTACQGVGCPGHKA
RVLAEAMSQVTNPATIMMQKGNFKNQRKTVKCFNCGKEGHLARNCRAPRKKGCWRCGKEG
HQMKDC-NERQANFLGKIWPSHKG-RPGNFLQSRP------------------EPTAP
PEESFRFGEETTTPAQKQEPIDKELYPLTSLRSLFGNDPSLQ
>gagC.syn1.1
MGARASILRGGKLDKWEKIRLRPGGKKHYMLKHLVWASRELERFALNPGLLETSEGCKQI
IKQLQPALQTGTEELRSLYNTVATLYCVHEKIEVRDTKEALDKIEEEQNKSQQKTQQAKA
ADG---KVSQNYPIVQNLQGCMVHQAISPRTLNAWVKVIEEKAFSPEVIPMFTALSEGAT
PQDLNTMLNTVGGHQAAMQMLKDTINEEAAEWDRLHPVHAGPIAPGQMREPRGSDIAGTT
STLQEQIAWMTSNPPIPVGDIYKRWIILGLNKIVRMYSPVSILDIKQGPKEPFRDYVDRF
FKTLRAEQATQDVKNWMTDTLLVQNANPDCKTILRALGPGATLEEMMTACQGVGGPSHKA
RVLAEAMSQ-ANNTNIMMQRSNFKGSKRIVKCFNCGKEGHIARNCRAPRKKGCWKCGKEG
HQMKDC-TERQANFLGKIWPSHKG-RPGNFLQSRPE------PTAPPA-------EPTAP
PAESFRFEE--TTPAPKQEPKDRE--PLTSLKSLFGSDPLSQ
>gagC.syn3.1
MGARASVLRGEKLDKWERIRLRPGGKKHYMLKHLVWASRELERFALNPSLLETSEGCKQI
IQQLQPALKTGTEELRSLFNTVATLYCVHAGIEVRDTKEALDKIEEEQNKCQQKTQQAKE
ADG---KVSQNYPIVQNLQGCMVHQALSPRTLNAWVKVIEEKAFSPEVIPMFTALSEGAT
```

Fig. 9 cont'd-6

```
PSDLNTMLNTVGGHQAAMQMLKDTINEEAAEWDRLHPVQAGPVAPGQMREPRGSDIAGTT
SNLQEQIAWMTGNPPVPVGDIYKRWIILGLNKIVRMYSPVSILDIRQGPKEPFRDYVDRF
FKTLRAEQSTQEVKNWMTETLLVQNANPDCKTILRALGPAASLEEMMTACQGVGGPSHKA
RVLAEAMSQ-ANSTNIMMQRGNFKGPKRIIKCFNCGKEGHLARNCRAPRKKGCWKCGKEG
HQMKDC-IERQANFLGKIWPSNKG-RPGNFLQNRPE------PTAPPVEPTAPPAEPTAP
PAESFKFEE--TTPAPKQEPKDRE--PLTSLRSLFGSDPLSQ
>gagC.syn3.2
MGARASILRGEKLDTWEKIRLRPGGRKHYMLKHIVWASRELEKFALNPGLLETSEGCKQI
MKQLQPALQTGTEELKSLYNTVATLYCVHEKIEVRDTKEAVDKIEEEQNKSQQKTQQAKA
ADE---KVSQNYPIVQNIQGQMVHQPISPRTLNAWVKVIEEKGFNPEVIPMFTALSEGAT
PQDLNTMLNTVGGHQAAMQMLKDTINDEAAEWDRLHPVHAGPIAPGQMREPRGSDIAGST
STLQEQITWMTSNPPVPVGEIYKRWIILGLNKIVRMYSPVSILDIKQGPKEPFRDYVDRF
FKVLRAEQATQDVKNWMTDTLLIQNANPDCKTILKALGPGASLEEMMTACQGVGGPGHKA
RVLAEAMSQ-ANNTNIMMQRSNFKGPKRIVKCFNCGKEGHIAKNCRAPRKKGCWKCGQEG
HQMKDC-TERQANFLGKIWPSQKG-RPGNFLQNRP-----------------EPSAP
PAESFRFGE--TTPAPKQELKDRE--PLTSLKSLFGSDPLSQ
>gagC.syn3.3
MGARASILRGGKLDKWEKIRLRPGGKKRYMLKHLIWASRELERFALNPGLLETAEGCKQI
IKQLQPALQTGTEELRSLYNTVATLYCVHKRIDVRDTKEALDKIEEEQNKIQQKTQQAKA
ADG---KVSQNYPIVQNAQGQMVHQAISPRTLNAWVKVVEEKAFSPEIIPMFTALSEGAT
PQDLNSMLNAVGGHQAAMQMLKDTINEEAAEWDRVHPVHAGPVAPGQIREPRGSDIAGTT
STLQEQIAWMTSNPPIPVGDIYKRWIIMGLNKIVRMYSPVSILDIKQGPKESFRDYVDRF
FKTLRAEQATQEVKNWMTDTLLVQNANPDCKTILRALGPGATLEEMMTACQGVGGPSHKA
RVLAEAMSQ-TNSA-ILMQRSNFKGSKRIVKCFNCGKEGHIARNCRAPRKRGCWKCGKEG
HQMKEC-TERQANFLGKIWPSHKG-RPGNFLQSRP-----------------EPTAP
PAESFRFEE--TTPAPKQESKDRE--PLISLKSLFGNDPLSQ >gagC.syn4.1
MGARASVLRGEKLDTWERIKLRPGGKKHYMIKHLVWASRELEKFALNPGLLETSEGCKQI
IQQLQPALKTGTEELKSLYNTVATLYCVHERIDVRDTKEALDKIEEEQNKIQQKTQQAKE
ADG---KVSQNYPIVQNAQGQMVHQALSPRTLNAWVKVVEEKAFSPEIIPMFTALSEGAT
PSDLNTMLNTIGGHQAAMQMLKDTINDEAAEWDRLHPVHAGPIAPGQIREPRGSDIAGTT
STLQEQITWMTSNPPVPVGEIYKRWIILGLNKIVRMYSPVSILDIKQGPKESFRDYVDRF
FKTLRAEQSTQEVKNWMTETLLVQNANPDCKTILKALGPGATLEEMMTACQGVGGPGHKA
RVLAEAMSQ-TNSA-ILMQRSNFKGSKRIVKCFNCGREGHIARNCKAPRKKGCWKCGKEG
HQMKDC-IERQANFLGKIWPSHKG-RPGNFLQNRPE------PTAPP--------EPTAP
PAESFRFGE--TTPAPKQEQKDRE--PLISLKSLFGSDPLLQ
>gagC.syn4.2
MGARASILRGEKLDKWERIRLRPGGKKHYMLKHLVWASRELDRFALNPGLLETSDGCKQI
IKQLHPALQTGTEELRSLFNTVATLYCVHAGIEVRDTKEAVDKIEEEQNKSQQKTQQAKA
ADE---KVSQNYPIVQNIQGQMVHQPISPRTLNAWVKVIEEKAFSPEVIPMFTALSDGAT
PQDLNTMLNTVGGHQAAMQMLKDTINEEAAEWDRIHPVHAGPVAPGQMRDPRGSDIAGST
STLQEQIAWMTNNPPVPVGDIYKRWIIMGLNKIVRMYSPVSILDIRQGPKEPFRDYVDRF
FRTLRAEQATQDVKNWMTDTLLIQNANPDCKTILRALGPASLEEMMTACQGVGGPGHKA
RVLAEAMSQ-ANNTNIMMQKSNFKGPKRTVKCFNCGKEGHIARNCRAPRKRGCWKCGKEG
HQMKEC-TERQANFLGKIWPSQKG-RPGNFLQSRP-----------------EPSAP
PAESFRFEE--TTPAPKQESKDRE--PLTSLKSLFGSDPSSQ
>gagC.syn4.3
MGARASILRGGKLDTWEKIRLRPGGKKRYMLKHLIWASRELERFALNPSLLETSEGCKQI
MKQLQPALQTGTEELRSLYNTVATLYCVHKGIKVQDTKEALDKIEEEQKKSQQKTQQAEA
ADK--GKVSQNYPIVQNLQGQMVHQPLSPRTLNAWVKVIERKAFSPEVIPMFSALSEGAT
PQDLNSMLNAVGGHQAAMQMLKDTINEEAAEWDRVHPVHAGPIAPGQMREPRGSDIAGTT
SNLQEQIAWMTSNPPIPVGDIYKRWIVLGLNKIVRMYSPVSILDIKQGPKEPFRDYVDRF
FKTLRAEQATQEVKNWMTDTLLVQNANPDCKTILRALGPAASLEEMMTACQGVGGPGHKA
```

Fig. 9 cont'd-7

```
RVLAEAMSQ-ANS-NIMMQRGNFKGPKRIIKCFNCGKEGHLARNCRAPRKKGCWKCGREG
HQMKDC-TERQANFLGKIWPSNKG-RPGNFLQSRP------------------EPTAP
PAESFGFGE--TTPAPKQELKDRE--PLTSLKSLFGNDPLSQ
>gagC.syn4.4
MGARASILRGGKLDKWEKIRLRPGGRKHYMLKHIVWASRELERFALNPGLLETAEGCKQI
IKQLQPALQTGTEELKSLFNTVATLYCVHEKIEVRDTKEALDKIEEEQNKCQQKTQQAKA
ADG---KVSQNYPIVQNLQGQMHQAISPRTLNAWVKVIEEKGFNPEVIPMFTALSEGAA
PQDLNTMLNTIGGHQAAMQMLKDTINEEAAEWDRLHPVQAGPVAPGQMREPRGSDIAGTT
SSLQEQIAWMTGNPPVPVGDIYKRWIILGLNKIVRMYSPVSILDIRQGPKEPFRDYVDRF
FKVLRAEQATQDVKNWMTETLLVQNANPDCKTIIRALGPGATLEEMMTACQGVGGPSHKA
RVLAEAMSQ-ANNANIMMQRSNFKGPKRIVKCFNCGKEGHIAKNCRAPRKKGCWKCGQEG
HQMKDC-NERQANFLGRIWPSHKG-RPGNFIQSRPEPTAPLEPTAPPA------EPTAP
PAESFKFEE--TTPAPKQEPKDRE--PLTSLRSLFGSDPLSQ >gagC.syn6.1
MGARASVLRGEKLDTWERIKLRPGGKKHYMIKHLVWASRELEKFALNPGLLETAEGCKQI
IRQLQPALQTGTEELRSLYNTVATLYCVHKRIDVRDTKEALDKIEEEQNSQQKAQQAKA
ADG---KVSQNYPIVQNLQGQMHQSLSPRTLNAWVKVIERKAFSPEVIPMFSALSEGAT
PQDLNTMLNTVGGHQAAMQMLKDTINEEAAEWDRIHPVHAGPIAPGQMREPRGSDIAGTT
STLQEQITWMTSNPPVPVGEIYKRWIILGLNKIVRMYSPVSILDIRQGPKEPFRDYVDRF
FKTLRAEQSTQEVKNWMTDTLLAQNANPDCKIILRGLGPGATLEEMMTACQGVGGPGHKA
RVLAEAMSQ-ANS-NILMQRSNFKGPRRTIKCFNCGKEGHLAKNCRAPRKKGCWKCGKEG
HQMKEC-TERQANFLGKIWPSQKG-RPGNFLQSRP-------------------EPSAP
PAESFRFEE--TTPALKQEPKDRE--PLTSLRSLFGSDPLSQ
>gagC.syn6.2
MGASASILRGEKLDRWEKIRLRPGGKKCYMLKHIIWASKELERFALNPGLLETSEGCKQI
MKQLQPALQTGTEELKSLYNTVATLYCVHEKIEVRDTKEALDKIEEEQKKSQQKTQQAEA
ADK---GKVSQNYPIVQNAQGQMHQALSPRTLNAWVKVVEEKAFSPEIIPMFTALSEGAA
PQDLNTMLNTVGGHQAAMQMLKDTINEEAAEWDRVHPVHAGPIAPGQIREPRGSDIAGTT
STLQEQVAWMTSNPPVPVGDIYKRWIVLGLNKIVRMYSPVSILDIKQGPKEPFRDYVDRF
FKTLRAEQSSQEVKNWMTDTLLVQNANPDCKTILRALGPAASLEEMMTACQGVGGPSHKA
RVLAEAMSQ-ANSTNIMMQRGNFKGPKRIVKCFNCGREGHIARNCRAPRKKGCWKCGQEG
HQMKDC-IERQANFLGKIWPSHKG-RPGNFIQSRPE------PTAPP--------EPTAP
PAESFRFGE--TTPAPKQESKDRE--PLTSLKSLFGNDPLSQ
>gagC.syn6.3
MGARASVLKGEKLDKWERIRLRPGGKKQYRLKHLVWASRELERFALNPSLLETSEGCRQI
IKQLQPALKTGTEELRSLYNTIATLYCVHGIKVQDTKEALDKVEEEQNSQQKTQQAKA
ADE---KVSQNYPIVQNLQGQMHQPLSPRTLNAWVKVIEEKGFNPEVIPMFTALSEGAT
PQDLNSMLNAVGGHQAAMQMLKDTINEEAAEWDRLHPVQAGPVAPGQIREPRGSDIAGTT
SSLQEQIAWMTGNPPVPVGDIYKRWIILGLNKIVRMYSPVSILDIKQGPKESFRDYVDRF
FKTLRAEQATQDVKNWMTETLLVQNANPDCKTILRALGPGATLEEMMTACQGVGGPSHKA
RVLAEAMSQ-ANNANIMMQRSNFKGPKRTVKCFNCGKEGHIAKNCRAPRKKGCWKCGREG
HQMKDC-IERQANFLGKIWPSNKG-RPGNFLQNRTE------PTAPPA-------EPTAP
PAESFRFEE--TTPAPKQELKDRE--PLTSLKSLFGSDPLLQ
>gagC.syn6.4
MGARASILRGEKLDKWEKIRLRPGGRKHYMLKHIVWASRELEGFALNPGLLETSEGCKQI
IKQLQPALQTGTEELRSLFNTVATLYCVHSGIEVRDTKEAVDKIEEEQNKIQQKTQQAKE
ADG---KVSQNYPIVQNSQGQMHQAISPRTLNAWVKVIEEKAFSPEVIPMFTALSEGAT
PSDLNTMLNTIGGHQAAMQMLKDTINDEAAEWDRLHPVHAGPIAPGQMRDPRGSDIAGST
STLQEQIAWMTNNPPVPVGDIYKRWIIMGLNKIVRMYSPVSILDIKQGPKEPFRDYVDRF
FRTLRAEQATQEVKNWMTETLLVQNANPDCRTILKALGPGATLEEMMTACQGVGGPGHKA
RVLAEAMSQ-ANNINIMMQRNNFKGPKRIIKCFNCGKEGHIARNCKAPRKKGCWKCGKEG
HQMKDC-NERQANFLGKIWPSHKG-RPGNFLQNRP-------------------EPTAP
PAESFRFEE--TTPTPKQEPKDRE--PLTSLKSLFGSDPSSQ
```

Fig. 9 cont'd-8

```
>gagC.syn6.5
MGARASILRGGKLDKWEKIRLRPGGKKRYMLKHLIWASRELERFAINPGLLETSDGCKQI
IQQLQPALKTGTEELKSLFNTVAVLYCVHKGIEVRDTKEAVDKIEEEQNKIQQKMQQQKV
TDG---KVSQNYPIVQNIQGQMVHQPISPRTLNAWVKVIEEKGFSPEVIPMFTALSEGAT
PSDLNTMLNTVGGHQAAMQMLKDTINEEAAEWDRTHPVHAGPVAPGQMREPRGSDIAGTT
STLQEQIGWMTNNPPIPVGEIYKRWIILGLNKIVRMYSPVSILDIKQGPKEPFRDYVDRF
FKALRAEQATQEVKGWMTDTLLVQNANPDCKTILKALGSGATLEEMMTACQGVGGPGHKA
RVLAEAMSQ-ANNTNIMMQKSNFKGPRRIVKCFNCGREGHIAKNCRAPRKKGCWKCGQEG
HQMKDC-TERQANFLGRIWPSHKG-RPGNFLQSRPE------PTAPL--------QPTAP
PAESFKFEE--TTPAPKQEQKDRE--PLTSLRSLFGNDPLSQ
>gagC.syn6.6
MGARASILRGGKLDTWEKIRLRPGGKKHYMLKHLVWASRELDRFALNPGLLETADGCKQI
IKQLHPALQTGTEELKSLFNTVATLYCVHAGIEVRDTKEALDKIEEEQNKCQQKTQQAKE
AEK---KVSQNYPIVQNLQGQMVHQAISPRTLNAWVKVIEEKAFNPEIIPMFTALSDGAT
PQDLNTMLNTVGGHQAAMQMLKDTINEEAADWDRLHPVHAGPVAPGQLREPRGSDIAGTT
SNLQEQIAWMTSNPPIPVGDIYKRWIILGLNKIVRMYSPVSILDIKQCPKEPFRDYVDRF
FKVLRAEQATQDVKNWMTDTLLIQNANPDCKTILRALGPGASLEEMMTACQGVGGPSHKA
RVLAEAMSQ-TNSA-ILMQRSNFKGSKRIVKCFNCGKEGHLARNCRAPRKRGCWKCGKEG
HQMKDCTTERQANFLGKIWPSHKGGRPGNFLQNRPE------PTAPL--------EPTAP
PAESFGFGE--TTPAPKQEPKDRE--PLISLKSLFGSDPLSQ >gagM.syn1.1
MGARASILRGGKLDKWEKIRLRPGGKKHYMLKHLVWASRELERFALNPGLLETSEGCKQI
IKQLQPALQTGTEELRSLFNTVATLYCVHEKIEVRDTKEALDKIEEEQNKSQQKTQQAKA
ADG---KVSQNYPIVQNLQGQMVHQAISPRTLNAWVKVIEEKAFSPEVIPMFTALSEGAT
PQDLNTMLNTVGGHQAAMQMLKDTINEEAAEWDRLHPVHAGPIAPGQMREPRGSDIAGTT
STLQEQIAWMTSNPPIPVGEIYKRWIILGLNKIVRMYSPVSILDIRQGPKEPFRDYVDRF
FKTLRAEQATQDVKNWMTDTLLVQNANPDCKTILRALGPGATLEEMMTACQGVGGPSHKA
RVLAEAMSQ-ANNTNIMMQRSNFKGSKRIVKCFNCGKEGHIARNCRAPRKKGCWKCGKEG
HQMKDC-TERQANFLGKIWPSHKG-RPGNFLQSRPE------PTAPPA-------EPTAP
PAESFRFEE--TTPAPKQEPKDRE--PLTSLKSLFCSDPLSQ >gagM.syn3.1
---RASVLSGGKLDAWEKIRLRPGGKKKYKLKHIVWASRELERFAVNPGLLETSEGCRQI
LGQLQPSLQTGSEELRSLYNTVAVLYCVHQRIEVKDTKEALEKIEEEQNKSKKKAQQAAA
DTGNSSQVSQNYPIVQNLQGQMVHQAISPRTLNAWVKVIEEKAFSPEVIPMFTALSEGAT
PSDLNTMLNTIGGHQAAMQILKDTINEEAAEWDRLHPVHAGPIAPGQMREPRGSDIAGTT
STLQEQIGWMTNNPPIPVGEIYKRWIILGLDKIVRMYSPTSILDIRQGPKESFRDYVDRF
YKTLRAEQASQEVKNWMTETLLVQNANPDCKTILKALGPAATLEEMMTACQGVGGPSHKA
RILAEAMSQVTNSATIMMQRGNFRNQRKTVKCFNCGKEGHIAKNCRAPRKKGCWKCGKEG
HQMKDC-NERQANFLGKIWPSHKG-RPGNFLQSRP------------------EPTAP
PEESFRFGEETTTPSQKQEPIDKELYPLASLKSLFGNDPLSQ
>gagM.syn3.2
MGARASILRGGKLDKWEKIRLRPGGKKHYMLKHLVWASRELERFALNPGLLETAEGCKQI
IKQLQPALKTGTEELKSLYNTVATLYCVHEKIEVRDTKEALDKLEEEQNKSQQKTQQAAA
GTGSSSKVSQNYPIVQNAQGQMVHQALSPRTLNAWVKVVEEKAFSPEVIPMFSALAEGAT
PQDLNTMLNTVGGHQAAMQMLKDTINEEAADWDRLHPVHAGPVAPGQMREPRGSDIAGST
STLQEQIAWMTSNPPIPVGDIYKRWIILGLNKIVRMYSPVSILDIKQGPKEPFRDYVDRF
FKTLRAEQATQDVKNWMTDTLLVQNANPDCKTILRALGPGASLEEMMTACQGVGGPGHKA
RVLAEAMSQ-ANNANIMMQRGNFKGQKR-IKCFNCGKEGHLARNCRAPRKKGCWKCGREG
HQMKDC-TERQANFLGRIWPSSKG-RPGNFPQSRP-----------------EPSAP
PAESFGFGE--TTPAPKQELKDRE--PLTSLKSLFGSDPLSQ
>gagM.syn3.3
MGARASVLSGGELDRWEKIRLRPGGKKKYRLKHLVWASRELEKFALNPGLLETSEGCKQI
MKQLQPALQTGTEELRSLFNTVATLYCVHQRIDVKDTKEALDKIEEEQNKIQQKTQQAKA
ADG---KVSQNYPIVQNIQGQMVHQPISPRTLNAWVKVVEEKGFNPEVIPMFSALSEGAT
```

Fig. 9 cont'd-9

```
PQDLNMMLNIVGGHQAAMQMLKETINEEAAEWDRVHPVHAGPIPPGQMREPRGSDIAGTT
SNLQEQIGWMTSNPPVPVGDIYKRWIVLGLNKIVRMYSPVSILDIRQGPKEPFRDYVDRF
FKVLRAEQATQEVKNWMTDTLLIQNANPDCKSILRALGPGATLEEMMTACQCVGGPSHKA
RVLAEAMSQ-TNSA-ILMQRSNFKGSKRIVKCFNCGKEGHIARNCRAPRKRGCWKCGQEC
HQMKDC-TERQVNFLGKIWPSNKG-RPGNFLQNRPE------PTAPPA-------EPTAP
PAESFRFEE--TTPAPKQEPKDRE--PLTSLRSLFGNDPSSQ

>gagM.syn4.1
MGARASVLSGGELDRWEKIRLRPGGKKKYKLKHIVWASRELERFAVNPGLLETSEGCRQI
LGQLQPSLQTGSEELRSLYNTVAVLYCVHQRIDVKDTKEALEKIEEEQNKSQQKTQQAKA
ADG---KVSQNYPIVQNAQGQMVHQAISPRTLNAWVKVIEEKGFSPEVIPMFSALAEGAT
PQDLNTMLNTIGGHQAAMQMLKDTINDEAAEWDRLHPVQAGPVAPGQIREPRGSDIAGTT
SNLQEQIGWMTSNPPIPVGDIYKRWIIMGLNKIVRMYSPTSILDIRQGPKESFRDYVDRF
FRTLRAEQASQEVKNWMTETLLVQNSNPDCKTILKALGPAATLEEMMTACQGVGGPGHKA
RVLAEAMSQ-VQQPNIMMQRGNFKGQKR-IKCFNCGREGHLARNCRAPRKKGCWKCGREG
HQMKDC-TESKANFLGKIWPSNKG-RPGNFLQSRP------------------EPSAP
PAESFGFGEE-ITPSQKQEQKDKELYPLASLKSLFGNDPLSQ
>gagM.syn4.2
MGARASVLSGGKLDAWEKIRLRPGGKKKYRLKHLVWASRELDRFALNPSLLETAEGCKQI
MKQLQPALKTGTEELKSLYNTVATLYCVHEKIDVRDTKEALDKIEEEQNKIQQKTQQAKE
ADG---KVSQNYPIVQNIQGQMVHQPISPRTLNAWVKVVEEKAFSPEVIPMFTALSDGAT
PQDLNSMLNAVGGHQAAMQILKDTINEEAADWDRLHPVHAGPVAPGQMREPRGSDIAGTT
STLQEQIGWMTNNPPIPVGEIYKRWIILGLNKIVRMYSPVSILDIKQGPKESFRDYVDRF
FKVLRAEQATQDVKNWMTDTLLIQNANPDCKSILRALGPGATLEEMMTACQGVGGPSHKA
RILAEAMSQVTNSATIMMQRGNFRNQRKTVKCFNCGKEGHLARNCKAPRKRGCWKCGKEG
HQMKEC-TERQANFLGKIWPSSKG-RPGNFPQSRP------------------EPTAP
PEESFRFGEETTTPSQKQEPIDKELYPLASLRSLFGNDPSSQ
>gagM.syn4.3
MGARASILRGGKLDWEKIRLRPCGKKRYMLKHLIWASRELERFALNPGLLETAEGCQQI
IEQLQSTLKTGSEELKSLFNTVATLYCVHQRIEVKDTKEALDKVEEEQNKSKKKAQQAAA
DTGNSSQVSQNYPIVQNLQGQMVHQALSPRTLNAWVKVIEEKAFSPEIIPMFTALSEGAT
PSDLNTMLNTVGGHQAAMQMLKDTINEEAAEWDRVHPVHAGPIPPGQMREPRGSDIACTT
SSLQEQIAWMTSNPPVPVGEIYKRWIVLGLNKIVRMYSPVSILDIRQGPKEPFRDYVDRF
FKTLRAEQASQDVKNWMTETLLVQNANPDCKTILRALGPGASLEEMMTACQGVGGPSHKA
RVLAEAMSQ-TNSA-ILMQRSNFKGSKRIVKCFNCGKEGHIARNCRAPRKRGCWKCGQEG
HQMKDC-NERQANFLGKIWPSHKG-RPGNFLQNRPE------PTAPP--------EPTAP
PAESFRFEE--TTPAPKQELKDRE--PLTSLKSLFGSDPLSQ
>gagM.syn4.4
MGARASVLRGEKLDKWERIRLRPGGKKHYMLKHLVWASRELEKFALNPGLLETSEGCKQI
IKQLQPALQTGTEELRSLFNTVATLYCVHAGIEVRDTKEALDKIEEIQNKSKQKTQQAAA
GTGSSSKVSQNYPIVQNLQGQMVHQPLSPRTLNAWVKVVEEKGFNPEVIPMFSALSEGAT
PQDLNMMLNIVGGHQAAMQMLKETINEEAAEWDRLHPVHAGPIAPGQMREPRGSDIAGST
STLQEQIAWMTGNPPVPVGDIYKRWIILGLNKIVKMYSPTSILDIKQGPKEPFRDYVDRF
YKTLRAEQATQEVKNWMTDTLLVQNANPDCKSILKALGTGATLEEMMSACQGVCGPAHKA
RVLAEAMSQ-ANNTNIMMQRSNFKGPKRIIKCFNCGKEGHIAKNCRAPRKKGCWKCGKEG
HQMKDC-TERQANFLGRIWPSSKG-RPGNFLQSRPE------PTAPPA-------EPTAP
PAESFKFEE--TTPAPKQEPKDRE--PLTSLRSLFGSDPLLQ >gagM.syn6.1
MGARASILSGGKLDAWEKIRLRPGGRKHYMLKHIVWASRELERFALNPGLLETAEGCQQI
IEQLQSTLKTGSEELKSLFNTVATLWCVHQRIEVKDTKEALDKLEEEQNKSQQKTQQAKA
ADG---KVSQNYPIVQNLQGQMVHQSISPRTLNAWVKAIEEKAFSPEVIPMFSALAEGAT
PQDLNTMLNTIGGHQAAMQILKDTINEEAAEWDRIHPVHAGPVAPGQMRDPRGSDIAGTT
SNLQEQIAWMTSNPPVPVGEIYKRWIILGLDKIVRMYSPVSILDIRQGPKEPFRDYVDRF
FKTLRAEQATQEVKCWMTDTLLVQNANPDCKTILKALGPGATLEEMSACQGVGGPGHKA
```

Fig. 9 cont'd-10

```
RVLAEAMSQ-ANNTNIMMQKSNFKGPKRIIKCFNCGKEGHLARNCRAPRKKGCWKCGQEG
HQMKDC-TERQANFLGRIWPSHKG-RPGNFPQSRL------------------EPTAP
PAESFGFGEE-IAPSPKQEPKEKELYPLTSLKSLFGNDPLSQ
>gagM.syn6.2
MGARASILRGGKLDKWEKIRLRPGGKKKYKLKHIVWASRELEKFALNPGLLETSEGCRQI
LGQLQPSLQTGSEELKSLYNTVATLYCVHQRIDVKDTKEALEKIEEEQNKSQQKTQQAAA
DKG----VSQNYPIVQNLQGQMVHQAISPRTLNAWVKVIEEKAFSPEIIPMFTALSEGAT
PQDLTTMLNTVGGHQAAMQMLKETINDEAAEWDRLHPVHAGPVAPGQLREPRGSDIAGST
STLQEQIAWMTGNPPVPVGDIYKRWIVLGLNKIVRMYSPTSILDIRQGPKEPFRDYVDRF
YKTLRAEQASQDVKNWMTETLLVQNANPDCRTILKALGPAATLEEMMTACQGVGGPAHKA
RVLAEAMSQVTNPATIMMQRGNFRNQRKTVKCFNCGKEGHLAKNCRAPRKRGCWKCGKEG
HQMKDC-NERQANFLGKIWPSNKG-RPGNFLQNRT------------------EPTAP
PAESFRFGEEKTTPSQKQEPIDKELYPLASLRSLFGNDPSLQ
>gagM.syn6.3
MGARASVLRGEKLDKWERIRLRPGGKKRYMLKHLIWASRELERFALNPSLLETSEGCKQI
IQQLQPALKTGTEELRSLYNTVATLYCVHEKIEVRDTKEAVDKIEEEQNKSKKKAQQAAA
DTGNSSQVSQNYPIVQNIQGQMVHQALSPRTLNAWVKVVEEKGFNPEVIPMFSALSEGAT
PQDLNMMLNIVGGHQAAMQMLKDTINEEAAEWDRLHPVQAGPVAPGQMREPRGSDIAGTT
STLQEQITWMTSNPPIPVGEIYKRWIIMGLNKIVRMYSPVSILDIKQGPKESFRDYVDRF
FRTLRAEQASQEVKNWMTETLLTQNANPDCKTILRALGPAASLEEMMTACQGVGGPGHKA
RVLAEAMSQ-TNSA-IILMQRSNFKGSKRIVKCFNCGKEGHIARNCRAPRKKGCWRCGKEG
HQMKDC-TESKANFLGKIWPSHKG-RPGNFLQNRPEPTAPPEPTAPPAEPTAPPAEPTAP
PAESFKFEE--TTPAPKQELKDRE---PLISLKSLFGSDPLLQ
>gagM.syn6.4
MGARASILRGEKLDTWEKIRLRPGGKKQYRLKHIVWASRELDRFALNPSLLETAEGCKQI
IKQLHPALQTGTEELRSLFNTVATLYCVHAGIEVRDTKEALDKIEEEQNKIQQKTQQAKA
ADE---KVSQNYPIVQNMQGQMVHQPLSPRTLNAWVKVVEEKAFSPEVIPMFAALSEGAT
PSDLNTMLNTVGGHQAAMQMLKDTINDEAAEWDRLHPAQAGPIPPGQIREPRGSDIAGTT
STPQEQIGWMTNNPPIPVGEIYKRWIVLGLNKIVRMYSPISILDIRQGPKEPFRDYVDRF
FKALRAEQATQEVKGWMTETLLVQNSNPDCKTILRALGPGASLEEMMTACQGVGGPSHKA
RILAEAMSQ-ANS-NIMMQRSNFKGPKRIVKCFNCGKEGHIAKNCRAPRKKGCWKCGREG
HQMKDC-IERQANFLGKIWPSQKG-RPGNFLQSRP------------------EPSAP
PAESFRFGE--TTPAPKQEPKDRE--PLTSLRSLFGSDPLSQ
>gagM.syn6.5
MGARASVLSGGELDRWEKIRLRPGGKKKYRLKHLVWASRELERFAINPGLLETSDGCKQI
IKQLQPALQTGSEELRSLYNTTATLYCVHQKIEVKDTKEALDKIEEIQNKSKQKTQQAAA
GTGSSSKVSQNYPIVQNAQGQMVHQSLSPRTLNAWVKVIEEKGFNPEVIPMFTALSEGAT
PHDLNTMLNTVGGHQAAMQMLKETINEEAAEWDRVHPVHAGPIPPGQMREPRGSDIAGST
STLQEQIGWMTSNPPIPVGDIYKRWIILGLNKIVRMYSPSSILDIRQGPKESFRDYVDRF
FKCLRAEQATQEVKNWMTDTLLIQNANPDCKSILRALGPGATLEEMMTACQGVGGPGHKA
RILAEAMSQ-VQQPNIMMQRGNFKGQKR-IKCFNCGREGHIARNCKAPRKKGCWKCGKEG
HQMKDC-TERQVNFLGKIWPSYKG-RPGNFLQSRP------------------EPTAP
PEESFRFGEETTTPSQKQETIDKELYPLASLKSLFGNDPSSQ
>gagM.syn6.6
MGARASVLSGGKLDAWERIRLRPGGKKHYMLKHLVWASRELERFAVNPGLLETSEGCKQI
MKQLQPALQTGTEELKSLYNTVAVLYCVHQRIEIKDTKEALDKIEEEQNKCQQKTQQAKE
ADG---KVSQNYPIVQNLQGQMVHQPISPRTLNAWVKVIEEKGFSPEVIPMFTALSDGAT
PQDLNSMLNAVGGHQAAMQMLKDTINEEAADWDRLHPVHAGPIAPGQMREPRGSDIAGTT
SSLQEQIAWMTNNPPVPVGEIYRRWIILGLNKIVKMYSPTSILDIKQGPKEPFRDYVDRF
FKVLRAEQATQDVKNWMTDTLLVQNANPDCKSILKALGTGATLEEMMTACQGVGGPSHKA
RVLAEAMSQVTNSATIMMQKGNFRNQRKIVKCFNCGREGHLARNCKAPRKRGCWKCGKEG
HQMKDC-TERQANFLGKIWPSSKG-RPGNFPQSRP------------------EPTAP
PAESFRFEE--TTPAPKQESKDRE--PLTSLKSLFGSDPSSQ
```

Fig. 10

>ENV-B.syn1.1
MRVTGIRKNYQHLWRWGTMLLWRWGTMLLGMLMICSATEKLWVTVYYGVPVWKEATTTLF
CASDAKAYDTEVHNVWATHACVPTDPNPQEVVLENVTENFNMWKNNMVEQMHEDIISLWD
QSLKPCVKLTPLCVTLNCTDDVRNVT-NNATNTNSSW-GEPMEKGEIKNCSFNITTSIRD
KVQKEYALFYKLDVVPI-DNDSNNTN---------YRLISCNTSVITQACPKVSFEPIPIH
YCAPAGFAILKCNDKKFNGTGPCTNVSTVQCTHGIRPVVSTQLLLNGSLAEEEVVIRSEN
FTNNAKTIMVQLNVSVEINCTRPNNNTRKSIHIGPGRAFYTTGDIIGDIRQAHCNISRAQ
WNNTLKHIVEKLGKQFGNNKTIVFNHSSGGDPEIVMHSFNCGGEFFYCNSTKLFNSTWTR
N-NGTWTRN---DTERSNSTE---EHITLPCRIKQIINMWQEVGKAMYAPPIRGQIRCSS
NITGLLLTRDGGNDT-----SGTEIFRPGGGDMRDNWRSELYKYKVVKIEPLGVAPTKAK
RRVVQREKRAVG-IGAVFLGFLGAAGSTMGAASMTLTVQARQLLSGIVQQQNNLLRAIEA
QQHLLQLTVWGIKQLQARVLAVERYLRDQQLLGIWGCSGKLICTTAVPWNASWSNKSLNE
IWNNMTWMEWEKEIDNYTNLIYNLLEESQNQQEKNEQELLELDKWASLWNWFDISNWLWY
IKIFIMIVGGLVGLRIVFAVLSIVNRVRQGYSPLSFQTRLPAPRGPDRPEGIEEEGGERD
RDRSVRLVDGFLALIWDDLRSLCLFSYHRLRDLLLIVTRIVELLG-------RRGWEALK
YWWNLLQYWSQELKNSAVSLLNATAIAVAEGTDRVIEALQRACRAILHIPRRIRQGLERA
LL- >ENV-B.syn3.1
MRVKETRKNYQHLWKWGTML---------LGMLMICSATEKLWVTVYYGVPVWRDANATLF
CASDAKAYDTEAHNVWATHACVPTDPNPQEVELKNVTENFNMWKNDMVEQMHEDIINLWD
QSLKPCVELTPLCVTLNCTDYVKNIT-NNATSTNSSW-GKPMEKGEIKFCSFNITTSIRN
KVQKQYALFYKLDIVPI-DNDNTS-----------YRLISCNTSTITQACPKVTFEPIPIH
YCAPAGFAILKCNNKTFNGTGPCTNVSTVQCTHGIRPVISTQLLLNGSLAEEEVVIRSEN
FTNNAKTIMVQLNVSVEINCTRPNNNTRRSIPIGPGRVFYTTEDIIGDIRQAHCNISRAQ
WNNTLKHIVEKLGKQFGNNKTIVFNHSSGGDPEIVMHSFNCRGEFFYCKSTKLFNSTWTR
N-NGTWTRN---DTERSNSTE---EHITLPCRIKQIINMWQEVGKAMYAPPIKGQISCSS
NITGLLLTRDGGKDT-----SGTEIFRPGGGDMRDNWRSELYKYKVVRIEPLGVAPTEAK
RRVVQREKRAVG-IGAVFLGFLGAAGSTMGAASMTLTVQARLLLSGIVQQQSNLLRAIEA
QQHMLQLTVWGIKQLQARLLAVERYLGDQQLLGLWGCSGKLICTTTVPWNTSWSNKSLNE
IWDNMTWMQWEREIDNYTGLIYNLLEKSQNQQEKNEQELLELDKWASLWNWFDITNWLWY
IKIFIMIVGGLVGLRIVFTVLSIVNRVRKGYSPLSFQTRLPTPRGPDRPGGIEEEGGEQD
RDRSGPLVNGFLALIWVDLRSLFLFSYHRLRDLLLIVARIVELLG-------RRGWETLK
YWWNLLLYWSQELKNSAVSLLNATAIAVAFGTDRVTEVVQRAFRAILHIPRRIRQGFERA
LL-
>ENV-B.syn3.2
MRVTGIRKNYQHLWRWGTMLLWRWGTMLLGILMICSAAGKLWVTVYYGVPVWKEANTTLF
CASDAKAYDTEVHNVWATHACVPIDPNPQEVVLGNVTENFNMWKNNMVEQMHEDIISLWD
ESLKPCVKLTPICVTLNCTDDVRNVT-NNATNTNSSW-GEPMEKGEIKNCSFNITTSIRD
KVQKQYALFYKLDVVPI-DNDSNNTN---------YRLISCNTSVITQACPKISFEPIPIH
FCAPAGFAILKCNDKKFNGTGPCKNVSTVQCTHGIKPVVSTQLLLNGSLAEEEIVIRSEN
FTDNAKTIIVQLNESVVINCTRPNNNTRKSIHIGPGRAFYATGEIIGDIRQAHCNLSRAK
WNDTLKQIVIKLREQFG-NKTIVFNQSSGGDPEIVMHSFNCGGEFFYCNTTQLFNSTWTW
N-NSTW--N---NTKRSNDTE---EIITLPCRIKQIVNMWQKVGKAMYAPPIRGQIRCSS
NITGILLTRDGGNNNET---NRTETFRPGGGNMKDNWRSELYKYKVVKIEPLGIAPTKAR
RRVVQREKRAVGTIGAMFLGFLGAAGSTMGAASLTLTVQARQLLPGIVQQQNNLLKAIEA
QQHLLRLTVWGIKQLQARVLAVERYLRDQQLLGIWGCSGKIICTTAVPWNASWSNKSLDK
IWDNMTWMEWEKEIDNYTNLIYNLLEESQNQQEKNELELLELDKWANLWNWFDISNWLWY
IKIFIMIIGGLVGLRIVFAVLSIVNRVRQGYSPLSFQTRLPAPRGPDRPEGIEEEGGERD
RDRSVRLVDGFLALIWDDLRSLCLFLYHRLRDLLLIAARIVELLG-------RRGWEALK
YWWNLLQYWSQELKNSAISLLNATAVAVAEGTDRVIEALQRACRAILHIPRRIRQGLERL
LL-
>ENV-B.syn3.3
MRVKGIRKNCQHLWRWGIML---------LGMLMICSAAEQLWVTVYYGVPVWKEATTTLF
CASDAKAYDKEVHNVWATHASVPTDPNPQEVVLENVTENFNMWKNNMVDQMHEDIISLWD
QSLKPCVKLTPLCVTLNCTD-LRNATNGNDTNTTSSS-REMMGGGEMKNCSFNVTTSIRD
KVQKEYALFYKLDVIPI-DSRNNSNKSTE--YNSYRLINCNTSVITQACPKVSFEPIPIH

Fig. 10 cont'd-1

YCTPAGFAILKCKDKKFNGTGPCTKVSTVQCTHGIRPVVSTQLLLNGSLAEEEVIIRSEN
FTNNAKTIIVQLKEAVEINCTRPSNNTRKSIPIGPGRAFYTTGDIIGDIRKAHCNISRAN
WNNTLRQIVEKLGEQFGNNKTIIFKQSSGGDPEIVTHSFNCGGEFFYCNSTQLFNSTWNF
--NGTWNKN---FNNTWNNTEGTNDTITLPCRIKQIINRWQEVGKAMYAPPISGQIRCSS
NITCLILTRDGGNNGNET--NGTEIFRPGGGNMRDNWRSELYRYKVVKIEPLGVAPTKAK
RRVVQREKRAVG-IGALFLGFLGAAGSTMGAASITLTVQARQLLSGIVQQQNNLLRAIEA
QQHLLQLTVWGIKQLQARILAVERYLKDQQLLGIWGCSGKLICTTAVPWNTSWSNRSLNE
IWNNMTWMEWEREIDNYTSLIYTLIEESQNQQEKNEQELLALDKWASLWNWFSITNWLWY
IRIFIMIVGGLIGLRIVFAVLSVVNRVRQGYSPLSFQTHLPAQRGPDRPEGTEEEGGERD
RDRSGRLVDGFLAIIWVDLRSLCLFSYHRLRDLLLIVTRIVELLG-------RRGWEVLK
YWWNLLQYWIQELKNSAVSLFNAIAIAVAEGTDRIIEVVQRAYRAILHIPTRIRQGLERA
LL-

>ENV-B.syn4.1
MRVTGIRKNYQHLWRWGTMLLWRWGTMLLGILMICSAAGKLWVTVYYGVPVWKDATTTLF
CASDAKAYDTEVHNVWATHASVPTDPNPQEVVLENVTEDFNMWKNNMVDQMHEDIISLWD
QSLKPCVELTPLCVTLNCTDDVRNVT-NNATNTNSSW-GEPMEKGEIKFCSFNITTSIRN
KVQKQYALFYKLDVVPI-DNDSNNTN---------YRLISCNTSVITQACPKVTFEPIPIH
YCAPAGFAILKCNNKTFNGTGPCTKVSTVQCTHGIRPVVSTHLLLNGSLAEEEVIIRSEN
FTDNTKTIIVQLKEAVEINCTRPNNNTRKGIHIGPGRAFYTTGEIIGDIRQAHCNLSRAK
WNDTLKQIVIKLREQFG-NKTIIFNQSSGGDPEIVMHTFNCGGEFFYCNTTQLFNSTW--
--------QN---ETSGSINITDIGENITLPCRIKQIVNMWQKVGKAMYAPPIKGQISCSS
NITGLLLTRDGGNNGNET--NGTEIFRPGGGNMKDNWRSELYRYKVVKIEPLGVAPTRAK
RRVVQREKRAVT-LGAMFLGFLGAAGSTMGAASMTLTVQARLLLSGIVQQQSNLLRAIEA
QQHLLRLTVWGIKQLQARILAVERYLQDQQLLGIWGCSGKLICTTAVPWNASWSNKSQDE
IWNNMTWMQWEKEIDNYTGLIYTLLEESQIQQEKNEQELLELDKWASLWNWFDITNWLWY
IKIFIMIVGGLIGLRIVFTVLSIVNRVRKGYSPLSFQTHLPAPRGPDRPGGIEEEGGEQD
RDRSGPLVNGFLALIWVDLRSLFLFSYHRLRDLLLIVARIVELLG-------RRGWEVLK
YWWNLLQYWSQELKNSAISLLNATAVAVAEGTDRVIEALQRACRAILHIPRRIRQGLERL
LL-
>ENV-B.syn4.2
MRVKGIRKNCQHLWRWGILL---------LGMLMICSAAEQLWVTVYYGVPVWRDANATLF
CASDAKAYDTEAHNVWATHACVPTDPNPQEVELKNVTENFNMWKNNMVEQMQEDIISLWD
QSLKPCVKLTPICVTLNCTDYVKNIT-NNATSTNSSW-GKPMEKGEIKNCSFNVTTSIRD
KVQKEYALFYRLDVVPI-DNDSNNNDSTNTNYTNYRLISCNTSTITQACPKVSFQPIPIH
YCAPAGFALLKCNDKKFNGTGPCKNVSTVQCTHGIKPVVSTQLLLNGSLAEEEIVIRSEN
FTNNAKTIIVQLNESVVINCTRPNNNTRKSIHIGPGRAFYATGDIIGDIRKAHCNISRAN
WNNTLRQIVEKLGEQFG-NKTIVFNQSSGGDVEIVMHSFNCGGEFFYCNSTQLFNSTWNF
--NGTWNKN---FNNTWNNTEGTNDTITLPCRIKQIINMWQGVGKAMYAPPISGQIRCSS
NITGLILTRDGGNN-NET--NRTETFRPGGGDMRDNWRSELYKYKVVKIEPLGIAPTKAR
RRVVQREKRAVGTIGAMFLGFLGTAGSTMGAASLTLTVQARLLLSGIVQQQNNLLKAIEA
QQHLLQLTVWGIKQLQARILAVERYLGDQQLLGLWGCSGKLICTTTVPWNASWSNKSLDK
IWDNMTWMEWEREIDNYTGLIYNLLEKSQNQQEKNELELLELDKWANLWNWFDITKWLWY
IKIFIMIIGGLIGLRIVFAVLSVVNRVRQGYSPLSLQTRLPTQRGPDRPECIAEEGGERD
RDRSGPLVDGFLAIIWVDLRSLCLFSYHHLRDLLLIVTRIVELLG-------RRGWEALK
YWWNLLLYWSQELKNSAVNLLNTTAIAVAEGTDRIIEVLQRIYRAFLHIPRRIRQGFERA
LL-
>ENV-B.syn4.3
MRVKEIRKNYQHLWKWGTML---------LGMLMICSAAGNLWVTVYYGVPVWKEANTTLF
CASDAKAYETEVHNVWATHACVPIDPNPQEVVLGNVTENFNMGKNNMVEQMHEDIISLWD
ESLKPCVKLTPLCVTLNCTDELKNATFRSNTTTNSSW--EKMEKGEIKNCSFNITTNMRD
KMQKEYALFYKLDVIPI-DSRNNSNNSTE--YNSYRLINCNTSVITQACPKISFEPIPIH
YCTPAGFAILKCKDKKFNGKGPCTNVSTVQCTHGIRPVVSTQLLLNGSLAEKEVVIRSDN
FTNNAKTIMVQLNVSVEINCTRPNNNTRRSIPIGPGRVFYTTEDIIGDIRQAHCNISRAQ
WNNTLKHIVEKLGKQFGNNKTIVFNHSSGGDPEIVMHSFNCRGEFFYCKSTKLFNSTWTR

Fig. 10 cont'd-2

```
N-NGTWTRN---DTERSNSTE---EHITLPCRIKQIINMWQEVGKAMYAPPIRGQIRCSS
NITGILLTRDGGNDT-----SCTEIFRPGGDMKDNWRSELYKYKVVRIEPLGVAPTEAK
RRVVQREKRAVG-IGAVFLGFLGAAGSTMGAAAVTLTVQARLLLSGIVQQQNNLLRAIEA
QQRLLQLTVWGIKQLQARVLAVERYLRDQQLLGIWGCSGKIICTTAVPWNTSWSNRSLNE
IWNNMTWMEWEKEIDNYTNLIYNLLEESQNQQEKNEQELLALDKWANLWNWFDISNWLWY
IKIFIIIVGGLVGLRIVFAVLSIVNRVRQGYSPLSFQTRLPAPRGPDRPEGIEEEGGERD
RDRSVRLVDGFLALIWDDLRSLCLFSYHRLRDLLLI----VELLG-------RRGWEILK
YWWNLLQYWGQELKNSAVSLLNATAIAVAEGTDRVIEVVQRAYRAILHIPTRIRQGLERA
LL-
>ENV-B.syn4.4
MRVKETRK

Fig. 10 cont'd-3

```
FTNNVKTIIVQLNETVEINCTRPNNNTRRSIPIGPGRVFYTTEDIIGDIRQAHCNLSRTQ
WNNTLKQIVTKLREQFG-NKTIIFNQSSGGDPEIVMHTFNCGGEFFYCNTTKLFNSTW--
--NDTTINR----TEGSNNTR----NITLPCRIKQIINLWQEVGKAMYAPPIQGQISCSS
NITGLLLTRDGGNN-NET--NRTETFRPGGGNMRDNWRSELYKYKVVKIEPLGVAPTKAK
RRVVQREKRAVG-IGALFLGFLGAAGSTMGAASVTLTVQARQLLSGIVQQRNNLLRAIEA
QQRMLQLTVWGIKQLRARVLAVERYLKDQQLMGIWGCSGKLICTTTVPWNASWSNKSLNE
IWDNMTWMEWEREIDNYTSLIYTLIEESQNQQEKNELELLELDKWASLWNWFSITNWLWY
IRLFIMIVGGLVGLRIVFTVISIVTRVRQGYSPLSFQTRLPTPRGPDRPGGIEEEGGEQD
RDRSIRLVDGFLALIWDDLRSLCLFSYHRLRDLLWI----VELLG-------RRGWEALK
YLWNLLQYWSQELKKSAVSLFNATAIAVAEGTDWVIEVIQRAFRAFIHIPTRVRQGLERA
LQ-
>ENV-B.syn6.3
MRVKGIRKNCQHLWRWGILL--------LGMLMICSATEKLWVTVYYGVPVWKETTTTLF
CASDAKAYVAEKHNVWATHACVPTDPNPREVVMGNVTEEFNIWNNSMVEQMHEDIISLWE
QSLKPCVKLTPLCVSLKCTDL------KNDTNTNSSSGRMIMEKGEIKNCSFNITTGIRG
KVQ-EYSLFYKLDVVQM-DEDNTS----------YRLINCNTSVITQACPKVSFQPIPIH
YCAPAGFAILKCKDKKFNGTGSCKNVSTVQCTHGIRPVISTQLLLNGSLAEGEVVIRSEN
FTDNAKTIIVQLKDPVKINCTRPNNNTRKSIPIGPGRAFYATGDIIGDIRQAHCNISTTK
WNKTLGQVVKKLREQFK-NKTIVFKQSSGGDPEVVMHSFNCGGEFFYCNTSQLFNSTW--
--------N---STSLFNSTN---GTITLQCRIKQIINRWQEVGKAMYAPPIEGQIRCLS
NITGLLLVRDGGINVTNN--TGTEVFRPGGGDMRDNWRSELYKYKVIKIEPLGVAPTRAK
RRVVQREKRAVG-LGAMFLGFLGAAGSTMGAASITLTVQARQLLSGIVQQQRNLLRAIEA
QQHMLQLTVWGIKQLQARVLAVERYLQDQQLLGIWGCSGKLICTTTVPWNTSWSNKSLNQ
IWDNMTWMQWEKEIDNYTGLIYTLLEESQNQQEKNEHELLELDKWASLWNWFNITNWLWY
IKIFIMIIGGLIGLRIVFAVLSIVNRVRQGYSPISFQTRLPAPRGPDRPDGIEEEGGDRD
RDRSGRLVDGFLTLIWVDLRSLCLFSYRRLRDLLLIAARIVELLG-------HRGWEALK
YWWNLLQYWIQELKNSAVNLLNTTAIAVAEGTDRVIEVVQRAYRAILNIPTRIRQGFERA
LL-
>ENV-B.syn6.4
MRVKEIRKNCQRLWRWGTML--------LGMLMICSAAEQLWVTVYYGVPVWRDANATLF
CASDAKAYDTEVHNVWATHASVPTDPNPQEVVLGNVTENFNMWKNDMVEQMHEDVISLWD
QSLKPCVKLTPICVTLNCTDYVKNIT-NNATSTNSSW-GEPMEKGEIKNCSFNITTSMKD
KVQKTYALFYKLDVVPI-DNDSNNNDSTNTNYTNYRLISCNTSVIKQACPKVSFDPIPIH
YCTPAGFAILKCRDKKFNGTGPCKNVSTVQCTHGIRPVVPTQLLLNGSLAEEEIVIRSEN
FSDNAKTIIVHLNESVEINCTRLNNNTRKSIHMGPGRAFYATGEIIGDIRQAHCNISRAK
WNNTLKQIAIKLREQFGNNKTIIFKQSSGGDPEIVTHSFNCGGEFFYCNSTQLFNSTWNF
--NGTWNKN---FNNTWNNTEGTNDTITLPCRIKQIINMWQKVGKAMYAPPISGQIRCTS
NITGLLLTRDGGN---DT--SGTEIFRPGGGNMKDNWRSELYKYKVVQIEPLGVAPTEAK
RRVVQREKRAVG-IGAVFLGFLGAAGSTMGAAAVTLTVQARLLLSGIVQQQNNLLKAIEA
QQHLLRLTVWGIKQLQARLLAVERYLGDQQLLGLWGCSGKLICTTAVPWNTSWSNRSLNE
IWNNMTWMEWEKEIDNYTNLIYNLLEESQNQQEKNEKELLELDKWANLWNWFDISNWLWY
IRIFIMIVGGLIGLRIVFIVLSVVNRVRQGYSPLSLQTRLPTQRGPDRPEGTEEEGGERD
RDTSGRLVDGFLAIIWVDLRSLFLFSYHRLRDLLLIVTRIVELLG-------RRGWEILK
YWWNLLQYWGQELKNSAVSLLNATAITVAEGTDRVIEVLQRAGRAILHIPTRIRQGLERI
LL-
>ENV-B.syn6.5
MRVKGIRRNYQHLWRWGIML--------LGMLMICSATEQLWVTVYYGVPVWKEANTTLF
CASDAKAYKTEAHNVWATHASVPTDPNPQEIVLENVTENFNMWKNNMAEQMHEDIINLWD
QSLKPCVELTPLCVTLNCTDELKNATFRSNTTTNSSW--EKMEKGEIKNCSFNVTTSIRD
KMQKEYALFYRLDVVPI-DNDNTS----------YRLISCNTSVITQACPKISFEPIPIH
YCVPAGFAILKCNNKTFNGTGPCTNVSTVQCTHGIKPVVSTQLLLNGSLAEEDVVIRSEN
FTDNTKTIIVQLKEAVEINCTRPNNNTRKGIHIGPGRAFYTTGEIIGNIRQAHCNLSRAK
WNDTLKQIVIKLREQFG-NKTIVFNQSSGGDVEIVMHSFNCGGEFFYCNTTQLFNSTW--
--NANDIRN---VTRGSNRTTGGNDTLILPCRIKQIVNMWQEVGKAMYAPPIKGQIKCSS

Fig. 10 cont'd-4

```
NITGLLLTRDGGNNGNET--NGTEIFRPGGGDMRNNWRSELYKYKVVRIEPLGVAPTKAR
RRVVQREKRAVT-LGAMFLGFLGAAGSTMGAASMTLTVQARLLLSGIVQQQSNLLRAIEA
QQRLLQLTVWGIKQLQARILAIERYLKDQQLLGIWGCSGKIICTTAVPWNASWSNKSQDE
IWNNMTWMQWEREIDNYTGLIYNLIEESQNQQEKNEQELLALDKWANLWNWFDITKWLWY
IKIFIMIVGGLIGLRIVFTVLSIVNRVRKGYSPLSFQTRLPAQRGPDRPEGIEEEGGERD
RDRSGPLVDGFLAIFWVDLRSLFLFSYRHLRDLLLIVARIVELLG------RRGWELLK
YWWNLLQYWSQELKSSAVSLLNATAIAVAEGTDRILEVLQRAYRAILHIPVRIRQGLERA
LL-
>ENV-B.syn6.6
MRVKGIRKNYQHLWRWGMML--------FGMLMICSAAGNLWVTVYYGVPVWREATTTLF
CASDAKAYETEVHNVWATHACVPTDPSPQEVVLENVTEDFNMWKNNMVDQMHEDIISLWD
ESLKPCVKLTPLCVTLNCTDDVRNVT-NNATNTNSSW-GEPMEKGEIKFCSFNITTSIRN
KVQKQYALFYKLDVIPI-DSRNNSNNSTE--YNSYRLINCNSSTITQACPKVTFEPIPIH
YCAPAGFAILKCNNKKFNGTGPCNNVSTVQCTHGIRPVVSTQLLLNGSLAEKEVVIRSDN
FTNNAKTIIVQLNESVVINCTRPNNNTRKRISMGPGRVYYTTGEIIGDIRRAHCNISRAQ
WNNTLKHTVRKLGKQFGNNKTI-FNHSGGDPEIVMHSFNCRGEFFYCKSTKLFNSTWTR
N-NGTWTRN---DTERSNSTE---EHITLPCRIKQIINMWQGVGKAMYAPPIRGQIRCSS
NITGLILTRDGGNNDT----RGTEIFRPGGGDMKDNWRSELYRYKVVKIEPLGIAPTKAK
RRVVQREKRAVGTIGAMFLGFLGTAGSTMGAASLTLTVQARLLLSGIVQQQNNLLRAIEA
QQHLLQLTVWGIKQLQAKVLAVERYLRDQQLLGIWGCSGRLICTTNVPWNASWSNKSLDK
IWNNMTWMEWDREINNYTSLIYSLIEESQNQQEKNEQDLLALDKWASLWNWFDITNWLWY
IKIFIMVVGGLVGLRIIFAVLSIVNKVRQGYSPLSLQTHLPARRGPDRPEGIEGEGGERD
RDRSVRLVDGFLALFWDDLRSLCLFLYHRLRDLLLIVTRTVELLG--------RRGWEALK
YCWNLLQYWSQELKNSAVSLFNAIAIAVAEGTDRIIEVVQRICRAIRHIPRRIRQGFERA
LL- >ENV-C.syn1.1
MRVRGIQRNWPQWWIWGILG--------FWMLMICNVVGNLWVTVYYGVPVWKEAKTTLF
CASDAKAYEKEVHNVWATHACVPTDPNPQEIVLENVTENFNMWKNDMVDQMHEDIISLWD
QSLKPCVKLTPLCVTLNCTDVKNATSNGTTTYNSI-DS--MNGEIKNCSFNTTTEIRD
KKQKVYALFYRLDIVPL-DNNSSE----------YRLINCNTSTITQACPKVSFDPIPIH
YCAPAGYAILKCNNKTFNGTGPCNNVSTVQCTHGIKPVVSTQLLLNGSLAEEEIIIRSEN
LTNNAKTIIVHLNESVEIVCTRPNNNTRKSIRIGPGQTFYATGDIIGDIRQAHCNISEKQ
WDQTLYRVSEKLKEHFP-NKTIKFAPSSGGDLEITTHSFNCRGEFFYCNTSKLFNSTY--
---NSTQMHN---DTGS--NST-----ITLPCRIKQIINMWQEVGRAMYAPPIAGNITCKS
NITGLLLTRDGGTNN-----NNTETFRPGGGDMRDNWRSELYKYKVVEIKPLGIAPTKAK
RRVVEREKRAVG-IGAVFLGFLGAAGSTMGAASITLTVQARQLLSGIVQQQSNLLRAIEA
QQHMLQLTVWGIKQLQTRVLAIERYLKDQQLLGIWGCSGKLICTTAVPWNSSWSNKSQTD
TWDNMTWMQWDREISNYTDTIYRLLEDSQNQQEKNEKDLLALDSWKNLWNWFDITNWLWY
IKIFIMIVGGLIGLRIIFAVLSIVNRVRQGYSPLSFQTLTPNPRGPDRLGRIEEEGGEQD
RDRSIRLVSGFLALAWDDLRSLCLFSYHRLRDFILVTARAVELLGRSSLRGLQRGWEALK
YLGSLVQYWGLELKKSAISLLDTIAIAVAEGTDRIIELIQRICRAIRNIPRRIRQGFEAA
LL- >ENV-C.syn3.1
MRVMGIQRNCQQWWIWGSLG--------FWMLMIYNVMGNLWVTVYYGVPVWKEAKTTLF
CASDAKAYDTEVHNVWATYACVPTDPNPQEMVLENVTENFNMWKNNMVDQMHEDIISLWD
QSLKPCVKMTPLCVTLNCSNAKKD---------NTTI-DNE-MKGEIKNCSFNITTELRD
KKKQVYALFYKLDIVPL-NSNSSE----------YRLINCNTSAITQACPKVSFDPIPIH
YCAPAGYAILKCNNETFNGTGPCNNVSTVQCTHGIRPVVSTQLLLNGSLAEKEIIIRSEN
LTDNVKTIIVHLNESVEINCTRPNNNTRRSIRIGPGQAFYATGEIIGDIRQAYCNISGEK
WNETLQRVGKKLKEHFP-NKTIKFAPSSGGDLEITTHSFNCRREFFYCNTSGLFNGTY--
---NGNGTYN---GTGTDTNST-----ITIPCRIKQIINMWQEVGRAMYAPPIEGNITCKS
NITGLLLVRDGGTENNTET-NNTETFRPGGGDMRDNWRSELYRYRVVEIKPLGIAPTKAK
RRVVERGKRAVG-IGAVFLGFLGVAGSTMGAASITLTVQARQVLSGIVQQQSNLLRAIEA
QQHLLQLTVWGIKQLQTRVLAIERYLKDQQLLGIWGCYSGKLICTTAVPWNSSWSNRSQED
```

Fig. 10 cont'd-5

```
LWNNMTWMQWDREINNYTNTIYRLLEDSQNQQEKNEQDLLALDSWKNLWNWFDITNWLWY
IRIFIMIVGGLIGLRIIFAVLSIVNRVRQGYSPLSLQTLTPNPRELDRLGRIEEGGGEQD
RDRSIRLVSGFLALAWDDLRSLCLFSYHRLRDFILIAARAAELLGRSSLKGLQRGWEILK
YLGSLIQYWGLELKKSAINLLDTIAIVVAEGTDRIIELIQRICRAICNIPRRIRQGFEAA
LQ-
>ENV-C.syn3.2
MRVRGILRNWQQWWIWGILG--------FWMLMICNVVGNLWVTVYYGVPVWREAKTTLF
CASDAKAYEREVHNVWATHACVPTDPNPQELVLENVTENFNMWKNDMVDQMHQDIISLWD
ESLKPCVKLTPLCVTLKCVNVTKNS--NATVNSNATV-NNNTMGEEEIKNCSFNATTEIRD
KKQNVYALFYRLDIVPL-NENNDNSS--------YRLINCNTSTITQACPKVTFDPIPIH
YCTPAGYAILKCNDKTFNGTGPCHNVSTVQCTHGIKPVISTQLLLNGSLAEEEIIIRSEN
LTNNVKTIIVHLNKSVEIVCTRPGNNTRKSVRIGPGQTFYATGDIIGDIRQAHCNISRTA
WNKTLQEVGKKLAEHFP-NKTIEFKPSSGGDLEVTTHSFNCRGEFFYCNTSKLFNSTYNS
TYNSTYNSN---STNSNSNST-----ITLQCRIKQIINMWQKVGRAIYAPPIAGNITCRS
NITGLLLTRDGGNNNDTCNNNDTEIFRPGGGDMKDNWRNELYKYKVVEVKPLGIAPTGAK
RRVVEREKRAVG-LGAVFLGFLGAAGSTMGAASMTLTVQARQLLSGIVQQQNNLLRAIEA
QQHMWQVTVWGIKQLQARVLALERYLKDQQLLGLWGCSGKLICTTNVPWNSSWSNKSLTD
IWENMTWMQWDKEISNYTDTIYRLLEVSQNQQEKNEKDLLALDSWNNLWNWFSITKWLWY
IKIFIMIVGGLIGLRIIFGVLSIVKRVRQGYSPLSFQTLTPNPRGPDRLGRIEEEGGEQD
KDRSIRLVNGFLALAWDDLRNLCLFSYHQLRDFILIVARAVELLGHSSLRGLQRGWEALK
YLGSLVQYWGLELKRSAISLLDTTAIAVAEGTDRIIEVIQRICRAIRNIPTRIRQGFEAA
LLQ
>ENV-C.syn3.3
MRVRGIQRNWPQWWIWGILG--------FWMIIICRVVGNLWVTVYYGVPVWTEAKATLF
CASDAKAYEKEVHNVWATHSCVPTDPNPQEIVLGNVTENFNMWENDMVDQMHEDVISLWD
QSLKPCVKLTPLCVTLNCT--------NANVTVNATSDGS--IKEEIKNCSFNTTTFIRD
KKQKVYALFYRPDTVPLSGSNSSE----------YILINCNTSTVTQACPKVSFEPIPIH
YCAPASYAILKCNNKTFNGTGPCQNVSTVQCTHGIKPVVSTQLLLNGSLAEGEIIIRSEN
LTNNAKTIIVHLNESIEIVCTRPNNNTRKSIRIGPGQTFFATGDIIGNIRQAHCNTSEEK
WNKTLQEVSRKLREHFP-NKTIIFNSSSGGDLEITTHSFNCGGEFFYCNTTKLFNDS---
--------------ALSAFNKTS--NETITLPCRIKQIINMWQGVGRAMYAPPIAGNITCNS
SITGLLLTRDGGT-------NNTEIFRPGGGNMKDNWRSELYKYKVVEIKPLGVAPTEAK
RRVVEREKRAVG-IGAVLLGFLGAAGSTMGAASITLTAQARQLLSGIVQQQSNLLKAIEA
QQHMLQLTVWGIKQLQARVLAIERYLQDQQLLGIWGCSGKLICTTTVPWNSSWSNKSQTD
IWDNMTWMQWDREISNYTNTIYRLLEESQNQQEQNEKDLLALDKWQNLWSWFSTTNWLWY
IKIFITTVGGLTGLRIILGVLSIVRRVRQGYSPLSFQTLIPNPRGPDRLGGIEEEGGEQD
RDRSVRLVSGFLSLAWDDLRSLCLFCYHRLRDFILVTARAVELLGRSSLRGLQKCWEALK
YLGNLVQYWGLELKKSAISLLDTIAIAVAEGTDRIIEFIQRICRAIRNIPRRIRQGLEAA
LQ-
>ENV-C.syn4.1
MRVRGILRNYQQWWIWGSLG--------FWMLMIYNVGGNLWVTVYYGVPVWKEAKTTLF
CASDAKAYDTEVHNVWATHACVPTDPDPQEIVLENVTENFNMWENDMVDQMHEDIISLWD
ESLKPCVKLTPLCVTLKCTNVTST---GNTTRGNNTS-EN---REEMKNCSFNTTTEIRD
KKQKVYALFYKPDVVPL-KENSSE----------YILINCNTSTVTQACPKVSFDPIPIH
YCAPAGFAILKCNNKTFNGTGPCNNVSTVQCTHGIKPVVSTQLLLNGSLAEEEIIIRSEN
LTDNAKTIIVHLNESIEIVCTRPGNNTRKSIRIGPGQAFYATGDIIGDIRQAYCNISKAT
WNKTLQEVGKELAKHFP-NKTINFNSSSGGDLEITTHSFNCGGEFFYCNTTKLFNNSI--
--------------LNNTADNST---STITLQCRIKQIINMWQGVGQAMYAPPIAGNITCKS
NITGLLLLRDGGDTST----NGTEIFRPGGGNMKDNWRSELYKYKVVEVKPLGIAPTGAK
RRVVEREKRAVG-IGAVLLGFLGAAGSTMGAASITLTAQARQVLSGTVQQQSNLLRAVEA
QQHMLQLTVWGIKQLQTRVLAIERYLKDQQLLGIWGCSGKLICTTNVPWNSSWSNKSQEE
IWENMTWMQWDREISNYTGTIYRLLEESQNQQEKNEQDLLALDSWKNLWNWFDISNWLWY
IKIFIIIVGGLIGLRIIFGVLSIVKRVRQGYSPLSFQTLIPNPRGPDRLERIEEEGGEQD
RGRSIRLVSGFLAIAWDDLRSLCLFSYHQLRDFILIAVRAVELLGHSSLRGLQRGWEALK
YLGSLVQYWGLELKRSAISLLDTIAIVVAEGTDRIIEFIQRICRAIRNIPTRIRQGFEAA
LQ-
```

Fig. 10 cont'd-6

```
>ENV-C.syn4.2
MRVMGIQRNCQQWWIWGILG--------FWILMICNVMGNLWVTVYYGVPVWKEAKATLF
CASDAKAYEKEVHNIWATHACVPTDPNPQELVLENVTENFNMWDNDMVDQMHQDIISLWD
QSLKPCVKLAPLCVTLNCTNATVTATRNGSDIMNTTS-ND----GEMKNCSFNVTTELRD
KKKKEYALFYRLDIVPL-NEGSGNANQNNSNYSDYRLINCNTSAITQACPKVTFDPIPIH
YCTPAGYAILKCNDKTFNGTGPCHNVSTVQCTHGIRPVVSTQLLLNGSLAEGEIMIRSEN
LTNNAKTIIVHLNKSVEIVCTRPNNNTRKSVRIGPGQTFYATNDIIGDIRQAHCNTSEEK
WNKTLQQVGKKLAEHFP-NKTIEFKPSSGGDLEVTTHSFNCRGEFFYCNTSGLFNGTF--
---DGT-------ESNSTSNAT-----ITIPCRIKQIINMWQKVGRAIYAPPIAGNITCRS
NITGLLLVRDGGNDNKT---NDTETFRPGGGDMRDNWRSELYKYKVVEVKPLGVAPTKAK
RRVVQREKRAVG-IGAVFLGFLGVAGSTMGAASMTLTVQARQVLSGIVQQQSNLLRAIEA
QQHLLQLTVWGIKQLQARVLALERYLRDQQLLGMWGCSGKLICTTAVPWNSSWSNKSQED
IWGNMTWMQWDKEISNYTNTIYRLLEDSQNQQERNEKDLLALDSWKNLWSWFDITNWLWY
IKIFIMIIGGLIGLRIIFAVLSIVNRVRQGYSPLSLQTLTPNPRGPDRLGRIEEEGGEQD
KDRSIRLVNGFLALAWDDLRNLCLFSYHRLRDFILIVARAVELLCRNSLRGLQRGWETLK
YLGSLIQYWGLELKKSAISLLDTTAIAVAEGTDRIIELIQRICRAICNIPRRIRQGLEAA
LQ-
>ENV-C.syn4.3
MRVRGIQRNWPQWWIWGILG--------FWMIIICRVVGNLWVTVYYGVPVWREAKTTLF
CASNAKAYEKEVHNVWATHACVPTDPNPQEIVLGNVTENFNMWKNDMVDQMHEDVISLWD
QSLKPCVKMTPLCVTLNCTDVKVNATSNGTTTYNNST-DS--MNGEIKNCSFNTTTELRD
KKQKAYALFYRPDIVPLPGKDNSKDNSSEYEE--YILINCNSSTITQACPKVSFEPIPIH
YCAPASYAILKCNNETFNGTGPCKNVSTVQCTHGIKPVISTQLLLNGSLAEKEIIIRSEN
LTNNVKTIIVHLKESVEINCTRPNNNTRKSIRIGPGQTFYATGDIIGNIRQAHCNISREK
WNTTLKRVKEKLKEHFP-NKTIKFAPSSGGDLEITTHTFNCRGEFFYCNTSKLFNSTYV-
---NRTDMND---D--TGNNST-----ITLPCRIKQIINMWQEVGRAMYAPPTAGNTTCNS
SITGLLLTRDGGNNT-----ENTETFRPGGGNMKDNWRNELYKYKVVEIKPLGVAPTEAK
RRVVEREKRAVG-LGAVFLGFLGAAGSTMGAASITLTVQARQLLSGIVQQQNNLLRAIEA
QQHMLQLAVWGIKQLQARVLAIERYLQDQQLLGIWGCSGKLICTTSVPWKSSWSNRSQED
IWNNMTWMQWDREISNYTDTIYRLLEVSQNQQEQNEKDLLALDKWQNLWSWFSITNWLWY
IRIFIMIVGGLIGLRIVFAVLSLVNRVRQGYSPLSFQTLTPSPRGPDRLGGIEEEGGEQD
RDRSIRLVSGFLSLAWDDLRSLCLFSYHRLRDFILIAARAAELLGRSSLRGLQRGWEILK
YLGSLAQYWGLELKKSAINLLDTIAIAVAEGTDRIIEVIQRICRAIYNIPRRIRQGFEAS
LL-
>ENV-C.syn4.4
MRVRGIPRNWQQWWIWGILG--------FWMLMICNVVGNLWVTVYYGVPVWTEAKTTLF
CASDAKAYEREVHNVWATYACVPTDPNPQEMVLENVTENFNMWKNDMVEQMHEDIISLWD
QGLKPCVKLTPLCVTLNCSNAKKD---------NTTI-DNE-MKGEIKNCSFNITTELRD
KKQQVYALFYKLDIVPL-NSNSSE-----------YRLINCNTSTITQACPKVNFDPIPIH
YCAPAGYAILKCNNKTFNGTGPCQNVSTVQCTHRIKPVVSTQLLINGSLAEGEIIIRSEN
LTDNVKTIIVHLNESVEIVCTRPNNNTRKSMRIGPGQTFYATGEIIGDIRQAHCNISKEK
WNNTLQEVREKLREHFP-NKTTKFAPHSGGDPEITTHSFNCRGEFFYCNTSQLFNSTY--
---NSTQMHN---DTGS--NST-----ITLPCKIKQIINMWQGVGRAMYAPPIEGNITCTS
NITGLLLTRDGGT-------NNTEIFRPGGGDMRNNWRSELYKYKVVEIKPLGIAPTKAK
RRVVERGKRAVG-IGAVLFGFLGAAGSTMGAASIALTAQARQLLSGIVQQQSNLLKAIEA
QQHMWQVTVWGIKQLQARVLAMERYLKDQQLLGLWGCSGKLICTTTVPWNSSWSNKSQTD
IWDNMTWMQWDREINNYTNTIYKLLEDSQNQQEKNEKDLLALDSWNNLWNWFSITKWLWY
IKIFIMIVGGLIGLRIILGVLSIVRRVRQGYSPLSFQTLTPNPREIDRLGRIEEGGEQD
RDRSVRLVSGFLALAWDDLRSLCLFCYHRLRDFILVTARAVELLGRSSLKGLQRGWEALK
YLGNLVQYWGLELKKSAISLFDTIAITVAEGTDRIIELVQRICRAIRNIPRRTRQGFEAA
LL-
>ENV-C.syn6.1
MRVRGIQRNWPQWWIWGILG--------FWIIIMCRVMGNMWVTVYYGVPVWREAKTTLF
CASDAKGYEKEVHNAWATHACVPTGPNPQEMVLENVTENFNMWKNNMVDQMHEDIINLWD
QSLKPCVRLTPLCVTLKCVNVTKNS--NATVNSNATV-NNNTMGEEIKNCSFNATTEIRD
KKQKAYALFYRPDIVPL-NENSSSENNSSE----YILINCNTSTITQACPKVSFDPIPTH
YCAPASYAILKCNNETFNGTGPCQNVSTVQCTHGIKPVISTQLLLNGSLAEEDIIIRSEN
```

Fig. 10 cont'd-7

```
LTNNAKTIIVHLNQSVEIVCTRPGNNTRKSMRIGPGQTFYATNDIIGNIRQAHCNISEGK
WNETLLRVKKKLEEHFP-NKTIKFEPSSGGDLEITTHTFNCRGEFFYCDTSTLFNHTY--
---VSAYMNNTDVSADRKNDTQ-SNSTITLPCRIRQIINMWQEVGRAIYAPPIAGNITCRS
NITGLLLVRDGGNTT-----NSTETFRPEGGNMKDNWRSELYKYKVVEIRPLGIAPTGAK
RRVVEREKRAVG-IGAVFLGFLGVAGSTMGAASMTLTVQARQVLSGVVQQQSNLLQAIEA
QQHLLQLTVWGIKQLQTRVLALERYLRDQQLLGIWGCSGKIICTTAVPWNTSWSNKSQED
IWNNMTWMQWDREINNYTNTIYKLLEESQNQQEKNEQDLLALDSWNSLWNWFSITKWLWY
IRIFIIIVGSLIGLRIIFGVLSIVKRVRQGYSPLLSQTLTPKPREPDRLGRIEEGGGEQD
RDRSVRLVNGFLALVWDDLRSLCLFCYHRLRDFILVTARVVELLGRSSLRGLQKGWEALK
YLGSLVQYWGLELKKSAINLLDTIAIAVGEGTDRIIEVIQRICRAIYNIPRRIRQGFEAS
LL-
>ENV-C.syn6.2
MRVRGILRNYQQWWIWGSLG---------FWMLMIYNVGGNLWVTVYYGVPVWTDAKTTLF
CASDAKAYDKEVHNVWATHACVPTDPNPQELVLENVTENFNMWKNDMVNQMHEDIISLWD
ESLKPCVKLTPLCVTLNCTNATVTATRNGSDIMNTIS-ND----GEMKNCSFNITTELRD
KKRKEYALFYRLDIVPL-DENNSSEKSSENSSEYYRLINCNTSAITQACPKVTFDPIPLH
YCAPAGYAILKCKDKTFNGTGPCSNVSTVQCTHGIKPVVSTRLLLNGSLAEGEIIIRSEN
LTNNVKTIIVHLKEPVEINCTRPNNNTRESIRIGPGQTFYATGDIIGDIRQAHCNISREK
WNKTLQEVGKKLAEHFP-NKTIKFAPHSGGDLEITMHSFNCRGEFFYCNTSGLFNGTY--
---MPTYMPN---GTESNSNST-----ITIPCRIKQIINMWQEVGRAMYAPPIEGNITCNS
NITGLLLVRDGGINKT-----NNTETFRPGGGDMRNNWRSELYKYKVVEIKPLGVAPTEAK
RRVVEREKRA-A-LGAMFLGFLGAAGSNMGAASITLTAQARQLLSGIVQQRSNLLRAIEA
QQHLLQLTVWGVKQLQARVLAMERYLKDQQLLGLWGCSGKLICTTSVPWNSSWSNRSQEE
IWNNMTWMEWDREISNYTNTIYRLLEDSQNQQEKNEKDLLALDSWKNLWSWFDITNWLWY
IKIFIMIIGGLIGLRIVFAVLSIVNRVRQGYSPLSFQTLTPSPRGPDRLGRIEEEGGEQD
KDRSVRLVSGFLSLAWDDLRSLCLFSYHRLRDLILIAARAVELLGHSSLRGLQRGWEILK
YLGSLAQYWGLELKRSAISLLDTIAITVAEGTDRIIEIIQRICRAICNIPRRIRQGFETA
LL-
>ENV-C.syn6.3
MRVMGILRNCQQWWIWGVLG---------FWMLMICNVVGNLWVTVYYGVPVWKEAKTTLF
CASNAKAYEREVHNIWATHACVPTDPNPQEMVLKNVTENFNMWKNDMVDQMHEDVISLWD
QSLKPCVKLAPLCVTLNCTNVTVNDTLHQNFT-------------DMKNCSFNVTTELRD
KKQKVYALFYRLDVVPL-GDNNSS---------YRLINCNTSTIAQACPKVNFDPIPIH
YCTPAGYAILKCNDKTFNGTGPCKNVSTVQCTHEIKPVVSTQLLLNGSLAEEGIIIRSEN
LTDNAKTIIVHLNESVEINCTRPGNNTRQSIRIGPGQAFYATGAIIGDIRQAHCNISKDE
WEKTLKRVSEKLKEHFP-NKTIEFKPSSGGDLEVTTHSFNCRREFFYCNTSKLFNSTY--
---NSTQMHN---DTGS--NST-----ITLPCKIKQIINMWQGVGQAMYAPPIKGNITCKS
NITGILLTRDGGNLT-----NGTETFRPGGGDMKDNWRSELYRYRVVEIKPLGIAPTKAK
RRVVQREKRAVG-IGALFLGFLGTAGSTMGAASLTLTVQARQLLSSIVQQQSNLLRAIEA
QQHMLQLTIWGIKQLQTRVLAVERYLKDQQLLGMWGCSGKLICTTAVPWNASWSNKSQEE
IWGNMTWMQWDREISNYTDIIYRLLEESQNQQERNEKDLLALDSWNNLWNWFNITNWLWY
IKIFIMIVGGVIGLRIIFAVLSLVNRVRQGYSPLSFQTLTPNPRELDRLGRIEEEGGEQG
RDRSIRLVNGFLAIAWDDLRSLCLFSYRRLRDFILIAARAAELLGRSSLRGLQRGWETLK
YLGSLIQYWGLELKKSAISLFDTIAIAVAEGTDRIIELIQRICRAIRNIPRRIRQGLEAA
LQ-
>ENV-C.syn6.4
MRVMGIQRNCQQWWIWGILG---------FWMLMIYNVVGNLWVTIYYGVPVWKEAKATLF
CASDAKAYDTEVHNVWATHACVPTDPDPQEMVLGNVTENFNMWKNDMADQMHEDIISLWD
QGLKPCVKLTPLCVTLHCTN-------TNTTNENRTI-GDKLNE-EMKNCSFNTTTELRD
KKQQVYALFYKPDVVPL-NGGEHNETGE------YILINCNSSTITQACPKVSFEPIPIH
YCAPAGFAILKCNNKTFNGTGPCHNVSTVQCTHGIRPVVSTQLLLNGSLAEEEIIIRSEN
LTDNVKTIIVHLNKSVEIVCTRPNNNTRKSIRIGPGQTFFATNDIIGDIRQAYCNISAEK
WNKTLERVEEKLKEHFP-NKTIKFNSSSGGDLEITTHSFNCRGEFFYCNTSNLFNGTY--
---EGTQSTN---ST----NST-----ITLQCRIKQIINMWQKVGRAMYAPPIAGNITCKS
NITGLLLLRDGGTEN-----NDTETFRPGGGNMRDNWRSELYKYKVVEVKPLGIAPTTAK
RRVVERDKRAVG-IGAVLLGFLGAAGSTMGAASMALTVQARQLLSGIVQQQSNLLRAVEA
```

Fig. 10 cont'd-8

```
QQHMLQLTVWGIKQLQARVLALERYLKDQQLLGIWGCSGRLICTTAVPWNSSWSNKTQGE
IWENMTWMQWDKETNNYTNTIYRLLEESQTQQEQNEKDLLALDSWKNLWNWFDITKWLWY
IKIFIMVVGGLIGLRIIFAVLSIVNSVRQGYSPLSLQTLTPNPRGPDRLERIEEEGGEQD
RNRSIRLVNGFLALAWDDLRSLCLFSYHHLRDFILVTARAVELLGRSSLKGLQRGWEALK
YLGNLVQYWGLELKKSAISLLDTTAIAVAEGTDRIIELVQRICRAILNIPTRIRQGFEAA
LQ-
>ENV-C.syn6.5
MRVRGIPRNWPQWWTWGILG--------FWMIIICRVVGNLWVTVYYGVPVWTEAKTTLF
CASDAKAYEREVHNVWATHSCVPTDPNPQEIVLGNVTENFNMWENDMVDQMHQDIISIWD
QSLKPCVKMTPLCVTLNCSNAKKD---------NTTI-DNE-MKGEIKNCSFNTTTETRD
KKQKVHALFYRLDIVPL-NEGSGNANQNNSNYSDYRLINCNTSTVTQACPKVTFDPIPIH
YCAPARYAILKCNNNTFNGTGPCNNVSTVQCTHGIKPVVSTQLLLSGSLAEEEIVIRSEN
LTKNAKIIIVHLNESVEIVCTRPNNNTRRSIRIGPGQTFYATGEIIGDIRQAHCNISAKQ
WNTTLERVKEKLREHFP-NKTIKFEPHSGGDPEITTHSFNCGGEFFYCNTSQLFNSTY--
---NSTYMSN---NTGENSNET-----ITLPCRIKQIINMWQQVGRAMYAPPIAGNTCNS
SITGLLLTRDGGNNNDTGNNNDTEIFRPGGGDMRDNWRSELYKYKVVELKPLGIAPTEAK
RRVVKREKRAVG-IGAVLFGFLGAAGSTMGAASIALTAQARQVLSGIVQQQNNLLRAIEA
QQHVLQLTVWGIKQLQTRVLAIERYLKDQQLLSLWGCSGKLICTTTVPWNSSWSNKSLTD
IWDNMTWMQWDREISNYTGTIYRLLEDSQSQQEKNEKDLLELDKWNNLWNWFDISNWLWY
IKIFIIIVGGLIGLRIIFAVLSIINRVRQGYSPLLFQTLTPNPRGLDRLGRIEEEGGEQD
KDRSIRLVNGFLALAWEDLRSLCLFSYHQLRDFILIVARAVELLG-------RRGWEALK
YLGNLVLYWGLELKKSAVSLLDTIAIAVAGGTDRIIEVVQRICRAIRNIPTRIRQGLEAA
LL-
>ENV-C.syn6.6
MRVRGILRNWQQWWIWGILG--------FWMVMICNVMGNLWVTVYYGVPVWQEAKTTLF
CASDAKAYEKEVHNVWATHACVPTDPSPQEIVLENVTENFNMWKNDMVEQMHEDIISIWD
QSLKPCVTLTPLCVTLNCTDVKVNATSNGTTTYNNSI-DS--MNGEIKNCSFNTTTEIRD
KKKQVYALFYKLDIVPL-NSNSSE---------YRLINCNTSAVTQACPKVSWDPIPIH
YCAPAGYAILKCNNKTFNGTGPCTNVSTVQCTHRIKPVVTTQLLLNGSLAEKEIIIRSEN
LTNNIKTIIVHLNESIEIVCTRPNNNTRKSVRIGPGQTFFATGDIIGDIRKAHCNISEDK
WNETLQRVGKKLVEHFP-NKTIKFAPSSGGDLEVTTHSFNCKGEFFYCNTTKLFD-----
-------------DSERINTTT---TTIILPCRIKQFINMWQGVGRAMYAPPIAGNTCTS
NITGLLLTRDGGT-------NNTEIFRPGGGNMKDNWRNELYKYKVVEVKPLGVAPTKAK
RRVVEREKRAVG-LGAVFLGFLGAAGSTMGAASITLTVQARQLLFGIVQQQSNLLKAIEA
QQHMWQVTVWGIKQLQARVLAIERYLQDQQLLGIWGCSGKLICTTNVPWNSSWSNKSQTD
IWDNMTWMQWDKEISNYTDTIYRLLEVSQNQQEENEKDLLALDKWQNLWNWFSITNWLWY
IRIFIMIVGGLIGLRIILGVLSIVRRVRQGYSPLSFQTLIPNPRGPDRLGGIEEEGGEQD
RDRSIRLVSGFLALAWDDLRNLCLFSYHRLRDFILIVVRAVELLGRNSLRGLQRGWEALK
YLGSLGQYWGLEIKKSAISLLDTIAIVVAEGTDRIIEFIQRFCRAIRNLPRRIRQGFEAA
LL- >ENV-M.syn1.1
MRVTGIRKNYQHLWRWGTMLLWRWGTMLLGMLMICSAAGNLWVTVYYGVPVWKEATTTLF
CASDAKAYDTEVHNVWATHACVPTDPNPQEVVLENVTENFNMWKNNMVEQMHEDIISIWD
QSLKPCVKLTPLCVTLNCTDDVRNVT-NNATNTNSSW-GEPMEKGEIKNCSFNITTSIRD
KVQKEYALFYKLDVVPI-DNDSNNTN--------YRLISCNTSVITQACPKVSFEPIPIH
YCAPAGFAILKCNDKKFNGTGPCTNVSTVQCTHGIKPVVSTQLLLNGSLAEEEVVIRSEN
FTNNAKTIIVQLNESVEINCTRPNNNTRKSIRIGPGQTFYATGDIIGDIRQAHCNISRAQ
WNNTLKHIVEKLGKQFGNNKTIVFNHSSGGDPEIVMHSFNCGGEFFYCNTTKLFNSTWTR
N-NGTWTRN---DTERSNSTE---EHITLPCRIKQIINMWQEVGKAMYAPPIRGQIRCSS
NITGLLLTRDGGNDT------SGTEIFRPGGGDMRDNWRSELYKYKVVKIEPLGVAPTKAK
RRVVQREKRAVG-IGAVFLGFLGAAGSTMGAASITLTVQARQLLSGIVQQQNNLLRAIEA
QQHLLQLTVWGIKQLQARVLAVERYLKDQQLLGIWGCSGKLICTTAVPWNSSWSNKSLNE
IWNNMTWMEWEREIDNYTGLIYTLIEESQNQQEKNEQELLELDKWASLWNWFDISNWLWY
IKIFIMIVGGLIGLRIVFAVLSIVNRVRQGYSPLSFQTRLPAPRGPDRPLGIEEEGGERD
RDRSIRLVSGFLALAWDDLRSLCLFSYHRLRDLLLIVTRIVELLG-------RRGWEALK
```

Fig. 10 cont'd-9

```
YWWNLLQYWSQELKNSAVSLLNATAIAVAEGTDRVIEALQRACRAILHIPRRIRQGLERA
LL-
>ENV-M.syn3.1
MRVRGIQRNWPQWWIWGILG--------FWMLMICNVVGNLWVTVYYGVPVWKEAKTTLF
CASDAKAYEKEVHNVWATYACVPTDPNPQEIHLENVTEEFNMWKNDMVDQMHEDIISLWD
QSLKPCVQLTPLCVTLNCTN-VKVTNLKNETNTKSSSGGEKMEEGEMKNCSFNITTSIRD
KVQKEYALFYKLDVVPI-DNDSNNTN--------YRLISCNTSVITQACPKVTFEPIPIH
YCTPAGFAILKCKDKKFNGTPCKNVSTVQCTHGIKPVISTQLLLNGSLAEEEIIIRSEN
ITNNAKTIIVQLNESVEINCTRPGNNTRKSVRIGPGQTFYATGEIIGDIRQAHCNLSRAK
WNDTLKQIVIKLREQFG-NKTIVFNQSSGGDPEIVMHSFNCGGEFFYCNTTQLFNSTW--
---------N---STSLFNSTN---GTITLQCRIKQIINMWQEVGKAMYAPPIEGNITCKS
NITGLLLVRDGGT---EP--NDTETFRPGGGNMKDNWRSELYKYKVVKIEPLGVAPTKAK
RRVVQREKRAVGTIGAMFLGFLAAGSTMGAASMTLTVQARLLLSGIVQQQNNLLRAIEA
QQHLLQLTVWGIKQLQARILAVERYLKDQQLLGLWGCSGKLTCTTAVPWNTSWSNKSQTD
IWDNMTWMEWEREIDNYTGLIYTLIEESQNQQEKNEQELLELDKWASLWNWFDITKWLWY
IKIFIMIVGGLVGLRIVFAVLSIVNRVRKGYSPLSFQTLTPNPRGPDRLGRIEEEGGEQD
RDRSIRLVSGFLALAWDDLRSLCLFSYHQLRDFILIVARAVELLGRESLRGLQRGWEALK
YLGSLVQYWGLELKKSAISLLDTIATAVAEGTDRIIEVIQRICRAIRNIPRRIRQGFERA
LL-
>ENV-M.syn3.2
MRVTGIRKNYQHLWRWGTMLLWRWGTMLLGILMICSAAGKLWVTVYYGVPVWRDAETTLF
CASDAKAHETEVHNIWATHACVPTDPNPQEVVLGNVTENFNMWKNNMVEQMHEDIISLWD
ESLKPCVKLTPICVTLNCTDDVRNVT-NNATNTNSSW-GEPMEKGEIKNCSFNMTTELRD
KKQKVHALFYKLDIVPL-NSNSSE---------YRLINCNTSAITQACPKVSFEPIPIH
YCAPAGFAILKCNDKKFNGTPCTNVSTVQCTHGIRPVVSTQLLLNGSLAEEEVVIRSEN
FTNNAKTIMVQLNVSVEINCTRPNNNTRKSIHIGPGRAFYTTGDIIGDIRQAHCNISRAQ
WNNTLKHIVEKLGKQFGNNKTIVFNHSSGGDPEITTHSFNCGGEFFYCNSTKLFNSTWTR
N-NGTWTRN---DTERSNSTE---EHITLPCRIKQIVNMWQRVGQAMYAPPIRGQIRCSS
NITGLLLTRDGGNDT-----SGTEIFRPGGGDMRNNWRNELYKYKVVRIEPLGVAPTRAK
RRVVEREKRAVG-LGAVFLGFLAAGSTMGAASLTLTVQARQVLSGIVQQQSNLLKAIEA
QQHLLKLTVWGIKQLQARVLAVERYLRDQQLLGIWGCSGKLICTTTVPWNASWSNKSLNE
IWNNMTWMEWEKEIDNYTNLIYNLLEESQNQQEKNEQDLLALDKWANLWNWFDISNWLWY
IKIFIIIVGGLIGLRIVFAVLSIINRVRQGYSPLSLQTLIPNPRGPDRPGGIEEEGGEQG
RDRSIRLVNGFLALAWDDLRNLCLFSYHRLRDLLLIVTRIVELLG-------RRGWEALK
YWWNLLQYWSQELKNSAISLLNATAVAVAEGTDRVIEALQRACRAILHIPRRIRQGLERL
LL-
>ENV-M.syn3.3
MRVKETRKNYQHLWKWGTML--------LGMLMICSAAEQLWVTVYYGVPVWKEATTTLF
CASDAKAYDTEVHNVWATHACVPTDPSPQEVVLENVTENFNMWKNDMVEQMHTDIISLWD
QSLKPCVKLTPLCVTLNCTDYVKNIT-KNATSTNSSW-GKPMEKGEIKNCSFNITTSIRN
KVQKQYALFYKLDIVPI-DNDNTS---------YRLINCNTSTITQACPKVSFDPIPIH
YCAPAGYAILKCNNKTFNGTPCNNVSTVQCTHGIKPVVSTQLLLNGSLAEGEIIIRSEN
LTNKAKTIIVHLNKSVEINCTRPSNNTRKSIRIGPGQAFYATGDIIGDIRKAHCNISGTK
WNHTLEQVMEELKKHFP-NKTIKFNSSSGGDLEITTHSFNCRGEFFYCNTSGLFNSTW--
---NDTTINR----TEGSNNTR----NITLPCRIKQIINMWQGVGRAMYAPPIAGNITCKS
NITGILLTRDGGNNN-----STNETFRPGGGDMRDNWRSELYKYKVVEIKPLGIAPTKAK
RRVVEREKRAVG-IGAVFLGFLGTAGSTMGAASITLTVQARQLLSGIVQQQSNLLRAIEA
QQHMLQLTVWGIKQLQTRVLAIERYLKDQQLLGIWGCSGKLICTTNVPWNSSWSNKSQSE
IWDNMTWMQWDREISNYTDTIYRLLEDSQNQQEKNEKDLLALDSWKNLWNWFDITKWLWY
IRIFIMIVGGLIGLRIIFAVLSIVNRVRQGYSPLSFQTRLPAPRGPDRPEGIEEEGGERD
RDRSVRLVDGFLALIWDDLRSLCLFSYHRLRDFILIAARTVELLGHSSLKGLRLGWEGLK
YLWNLLQYWIQELKNSAVSLLNATAIAVAEGTDRVIEVVQRAYRATLHTPTRIRQGLERA
LL-
```

Fig. 10 cont'd-10

>ENV-M.syn4.1
MRVKETRKNYQHLWKWGTML--------LGMLMICSAAEQLWVTVYYGVPVWKEATTTLF
CASDAKAHETEVHNIWATHACVPTDPNPQEVVLGNVTENFNMWKNDMVEQMHTDIISLWD
QSLKPCVELTPLCVTLHCTDL------GNATNT--------MEKGEIKNCSFNMTTELRD
KKQKVYALFYRLDIVPI-DNDNTS----------YRLINCNTSVIKQACPKVTFEPIPIH
YCTPAGFAILKCNDKNFNGTGPCKNVSTVQCTHGIRPVVSTQLLLNGSLAEKEIIIRSEN
LTDNAKTIIVHLNKSVEINCTRPSNNTRKSVRIGPGQTFYATGDIIGDIRQAHCNISRAK
WNNTLKQIVTKLREQFK-NKTIVFNQSSGGDLEITTHSFNCRGEFFYCNTTQLFNSTW--
-------KN---DTEVSNNTK-GNDTITLPCRIKQIVNMWQEVGRAMYAPPIEGNITCNS
NITGILLTRDGGNNGNET--NGTEIFRPGGGNMRDNWRNELYKYKVVEIKPLGVAPTEAK
RRVVEREKRAVG-IGAVFLGFLGAAGSTMGAASITLTVQARQLLTGIVQQQSNLLRAIEA
QQHMLQLTVWGIKQLQTRVLAIERYLKDQQLLGLWGCSGKLICTTAVPWNSSWSNKTYND
IWDNMTWMQWDREISNYTDTIYRLLEDSQNQQEKNEKDLLALDSWKNLWNWFDITNWLWY
IKIFIMIVGGLIGLRIIFAVLSIVNRVRQGYSPLSFQTLTPNPRGPDRPGGIEEEGGEQG
RDRSIRLVNGFLALAWDDLRNLCLFSYHQLRDFILIVARAVELLGRSSLRGLQRGWEALK
YLGSLVQYWGLELKKSAISLLDTIAIAVAEGTDRVIEVVQRAYRAILHIPTRIRQGLERL
LL-
>ENV-M.syn4.2
MRVRGIQRNWPQWWIWGILG--------FWMLMICNVVGNLWVTVYYGVPVWKEAKTTLF
CASDAKAYEKEVHNVWATHACVPTDPSPQEVVLENVTENFDMWKNNMVEQMQEDVISLWD
QSLKPCVKLAPLCVTLNCTDYVKNIT-NNATSTNSSW-GKPMEKGEIKFCSFNITTSIRN
KVQKQYALFYKLDVVQM-DEDNTS----------YRLISCNTSTITQACPKVTFDPIPIH
YCAPAGFAILKCNNKTFNGTGPCTNVSTVQCTHGIKPVVSTQLLLNGSLAEEEIIIRSEN
LTNNAKTIIVHLNESVEIVCTRPNNNTRKSIHIGPGRAFYATGEIIGDIRQAHCNLSRAK
WNDTLKQIVIKLREQFG-NKTIIFNQSSGGDPEITTHSFNCGGEFFYCNSTQLFNSTWNF
--NGTWNKN---FNNTWNNTEGTNDTITLPCKIKQIINMWQRVGQAMYAPPISGQIRCSS
NITGLILTRDGGN---DT--SGTEIFRPGGGDMRDNWRSELYKYKVVKIEPLGVAPTKAK
RRVVQREKRAVG-IGALFLGFLGAAGSTMGAASMTLTVQARQLLSGIVQQQSNLLKAIEA
QQHLLQLTVWGIKQLQARTLAVERYLKDQQLLGIWGCSGKLICTTTVPWNASWSNKSLNE
IWDNMTWMEWEREIDNYTGLIYNLIEESQTQQEKNEQELLELDKWASLWNWFDITKWLWY
IKIFIMIIGGLIGLRIVFTVLSIVNRVRKGYSPLSFQTLTHHQREPDRPERIEEGGGEQD
RDRSGRLVDGFLATIWVDLRSLCLFSYHRLRDLLLIVTRIVELLG-------RRGWEVLK
YWWNLLQYWSQELKNSAVSLLNATAIAVAEGTDRIIEVIQRICRAIRNIPRRIRQGLERA
LL-
>ENV-M.syn4.3
MRVKETQMNWPNLWKWGTLI--------LGLVIICSASDNLWVTVYYGVPVWKDAETTLF
CASDAKAYDTEVHNVWATYACVPTDPNPQEIHLENVTEEFNMWKNDMVDQMHEDIISLWD
ESLKPCVKLTPLCVTLNCTDDVRNVT-NNATNTNSSW-GEPMEKGEIKNCSFNITTSIRD
KVQKEYALFYKLDVVPI-DNDSNNTN--------YRLISCNTSVITQACPKVSFEPIPIH
YCAPAGYAILKCNDKKFNGTGPCNNVSTVQCTHGIKPVVTTQLLLNGSLAEGEIIIRSEN
ITNNAKTIIVQLNESVVINCTRPNNNTRKSIRIGPGQAFYATGDIIGNIRQAHCNISRAN
WNNTLRQIVEKLGEQFGNNKTIVFNHSSGGDPEIVTHSFNCAGEFFYCNTTKLFNSTWTR
N-NGTWTRN---DTERSNSTE---EHITLPCRIKQIINMWQEVGKAMYAPPIRGQIRCSS
NITGLLLTRDGGNNN-----STNETFRPGGGNMKDNWRSELYKYKVVQIEPLGIAPTKAK
RRVVEREKRAVG-LGAVFLGFLGTAGSTMGAASLTLTVQARQVLSGIVQQQRNLLRAIEA
QQHLLKLTVWGIKQLQARVLAIERYLQDQQLLGMWGCSGKLICTTNVPWNSSWSNKSQTD
IWDNMTWLQWDKEISNYTSLIYTLIEESQNQQEKNEQDLLALDKWASLWSWFDISNWLWY
IKIFIIIVGGLIGLRIVFAVLSIINRVRQGYSPLSLQTLIPNPRGPDRLGRIEEEGGEQD
RDRSIRLVSGFLALAWDDLRSLCIFSYHRLRDFILIAARTVELLGHSSLKGLRLGWEGLK
YLGNLLLYWGQELKNSAINLLDTIAIAVAGWTDRVIEIGQRAGRAILNIPRRIRQGFERA
LL-
>ENV-M.syn4.4
MRVTGIRKNYQHLWRWGTMLLWRWGTMLLGILMICSAAGKLWVTVYYGVPVWRDADTTLF
CASDAKAYDTEAHNVWATHASVPTDPNPQEIVLENVTENFNMWKNNMVEQMHEDIISLWD
QSLKPCVQLTPLCVTLNCTN-VNVTNLKNETNTKSSSGGEKMEEGEMKNCSFNITTEIRD
KKQKVHALFYKLDIVPL-NSNSSE----------YRLINCNTSAITQACPKVSFDPIPIH

Fig. 10 cont'd-11

YCTPAGYAILKCNNKKFNGTGPCKNVSSVQCTHGIKPVISTQLLLNGSLAEEEVVIRSEN
FTNNAKTIMVQLKVSVEINCTRPNNNTRRSIPIGPGRAFYTTGDIIGDIRKAHCNISRAQ
WNNTLKHIVEKLGKQFGNNKTIIFKPSSGGDPEIVMHSFNCGGEFFYCNTSGLFNSTW--
--------N---STSLFNSTN---GTITLQCRIKQIINMWQGVGRAMYAPPIAGNITCKS
NITGLLLVRDGGT---EP--NDTETFRPGGGDMKDNWRSELYKYKVVRIEPLGVAPTRAK
RRVVEREKRAIG-LGAMFLGFLGAAGSTMGAASVTLTVQARLLLSGIVQQQNNLLRAIEA
QQHLLRLTVWGIKQLQARVLAVERYLRDQQLLGIWGCSGKIICTTAVPWNTSWSNRSLNE
IWNNMTWMEWEKEIDNYTNLIYNLLEESQNQQEKNEQELLALDKWANLWNWFDISNWLWY
IRIFIMIVGGLVGLRIVFAVLSIVKRVRQGYSPLSFQTRLPAPRGPDRPEGIEEEGGERD
RDRSVRLVDGFLALIWDDLRSLCLFSYHHLRDLLLIVARIVELLG-------RRGWEALK
YWWNLLQYWIQELKNSAISLLNATAVAVAEGTDRVIEALQRACRAILHIPRRIRQGFEAA
LL-
>ENV-M.syn6.1
MRVMGIQRNCQQWWIWGILG--------FWMLMICNVMGNLWVTVYYGVPVWKEANTTLF
CASDAKAYEREVHNVWATHASVPTDPNPQEVVLENVTEDFNMWKNNMVEQMQEDVISLWD
QSLQPCVKLTPLCVTLNCTD-LRNATNGNDTNTTSSS-REMMGGGEMKNCSFNITTEIRD
KKQKVYALFYKLDVVPI-DNDSNNTN--------YRLISCNTSAVTQACPKVTFDPIPIH
YCTPAGFAILKCRDKKFNGTGPCNNVSTVQCTHGIKPVVTTQLLLNGSLAEEEIVIRSEN
FTDNAKTIIVQLKEAVEINCTRPNNNTRKGIHIGPGRAFYATGEIIGDIRQAHCNVSRSE
WNKTLQQVATQLRKHF--NKTIIFNSSSGGDLEITTHSFNCRGEFFYCNTSGLFNSTW--
--NDTTINR----TEGSNNTR----NITLPCRIKQFINMWQEVGRAMYAPPIAGNITCRS
NITGLLLTRDGGNNGNET--NGTEIFRPGGGDMRNNWRSELYKYKVVEIKPLGIAPTKAR
RRVVQREKRAVG-IGAVFLGFLSAAGSTMGAASITLTVQARQLLTGIVQQQSNLLKAIEA
QQHMLQLTVWGVKQLQARVLAVERYLRDQQLLGIWGCSGRLICTTAVPWNTSWSNKSLNE
IWDNMTWMEWEREIDNYTSLIYTLIEESQNQQEKNEQELLELDKWANLWNWFSITNWLWY
IRIFIMIVGGLIGLRIIFGVLSIVKRVRQGYSPLSFQTRLPAPRGPDRPEGIEEEGGERD
RDRSGRLVDGFLALIWDDLRSLCLFSYHRLRDLILIAARIVELLGHSSLKGLRLGWEALK
YLWNLLLYWGQELKNSAISLLNTTAIVVAEGTDRVIEVLQRAGRAILNIPRRIRQGFEAA
LL-
>ENV-M.syn6.2
MRVTGIRKNYQHLWRWGTMLLWRWGTMLLGILMICSAAGKLWVTVYYGVPVWREAKTTLF
CASDAKAYEKEVHNVWATYACVPTDPNPQEMVLENVTENFNMWKNNMVDQMHEDIISLWD
ESLKPCVKLTPLCVTLHCTDL------GNATNT---------MEKGEIKNCSFNTTTEIRD
KKQKVHALFYRLDVVPI-DNDNTS----------YTLINCNTSVITQACPKVTFEPIPIH
YCAPAGFAILKCNNKKFNGTGPCTNVSTVQCTHGIRPVVSTQLLLNGSLAEGEIIIRSEN
LTDNAKTIIVHLNESVEIVCTRPNNNTRKSVRIGPGQTFYATGAIIGDIRQAYCNISRAK
WNNTLKQIVTKLREQFGNNKTIIFKPPSGGDLEITMHHFNCRGEFFYCNTTQLFNSTWNF
--NGTWNKN---FNNTWNNTEGTNDTITLPCKIKQIINMWQGVGRAMYAPPISGQIRCSS
NITGLLLTRDGGT-------NNTEIFRPGGGNMRDNWRSELYKYKVVKIEPLGVAPTKAK
RRVVQREKRAVG-IGALFLGFLGAAGSTMGAASMTLTVQARQVLSGIVQQQRNLLRAIEA
QQHLLQLTVWGIKQLQARILAVERYLKDQKFLGLWGCSGKIICTTAVPWNASWSNKSLDD
IWNNMTWMQWEREIDNYTGLIYSLIEESQTQQEKNEQELLQLDKWASLWNWFDITNWLWY
IRLFIMIVGGLVGLRIVFTVLSIVNRVRKGYSPLSFQTLTHHQREPDRPERIEEGGGEQG
RDRSVRLVSGFLALFWDDLRSLCLFCYHRLRDFILIAARTVELLGHSSLKGLRRGWEGLK
YLWNLLQYWIQELKNSAISLLNATAVAVAEGTDRVIEALQRACRAILHIPRRIRQGLERL
LL-
>ENV-M.syn6.3
MRVRGIQRNWPQWWIWGILG--------FWMIIICRVVGNLWVTVYYGVPVWKDAETTLF
CASDAKSYETEAHNIWATHACVPTDPSPQEVVLGNVTENFNMWKNDMVEQMHEDIISLWD
QSLKPCVELTPLCVTLNCTDDVRNVT-NNATNTNSSW-GEPMEKGEIKNCSFNITTSIRN
KVQKQYALFYKLDVVQI-DDNNSTNTS-------YRLINCNTSAITQACPKVSFDPIPIH
YCAPAGYAILKCNNKTFNGTGPCHNVSTVQCTHGIRPVISTQLLLNGSLAEEEVVIRSEN
FTNNAKTIMVQLNVSVEINCTRPNKNTRKSIHIGPGRAFYTTGDIIGDIRQAHCNISRAQ
WKNTLKHIVEKLGKQFGNNKTIIFKPSSGGDPEIVMHSFNCRGEFFYCNTSKLFNSTWTR
N-NGTWTRN---DTERSNSTE---EHITLPCRIKQIINMWQRVGQAMYAPPIAGNITCNS
SITGLLLTRDGGN---DT--SGTEIFRPGGGNIKDNWRSELYKYKVVQIEPLGVAPTRAK

Fig. 10 cont'd-12

```
RRVVEREKRAVG-IGAMIFGFLGAAGSTMGAASMALTVQARQLLSGIVQQQSNLLMAIEA
QQHLLKLTVWGIKQLRARVLAVERYLKDQQLLGIWGCSGKHICTTNVPWNSSWSNKSLDE
IWNNMTWIEWEREINNYTGLIYNLLEKSQNQQEKNEQDLLALDKWASLWSWFDISNWLWY
IKIFIIIVGGLIGLRIVFAVLSLVNRVRQGYSPLSLQTLLPTPRGPDRPEGTEEEGGEQG
RDRSIRLVSGFLALAWDDLRSLCRFSYHRLRDFILIVARTVELLGRSSLKGLRLGWEGLK
YLGNLLLYWGQELKISAISLLDTTAIAVAGWTDRVIEIGQRLCRAIRNIPRRIRQGAERA
LQ-
>ENV-M.syn6.4
MRVKETQMNWPNLWKWGTLI--------LGLVIICSASDNLWVTVYYGVPVWRDADTTLF
CASDAKAHETEVHNVWATHACVPTDPNPQEIHLENVTEEFNMWKNNMVEQMHTDIISLWD
QSLKPCVRLTPLCVTLNCTDELKNATFRSNTTTNSSW--EKMERGEIKNCSFNITTSIRD
KVQKEYALFYKLDIVPL-NSNSSE---------YRLINCNTSVIKQACPKISFDPIPIH
YCAPAGFAILKCKDKKFNGTGPCQNVSTVQCTHRIKPVVSTQFLLNGSLAEEDIIIRSEN
ITNNAKTIIVQLNESVVINCTRPNNNTRRSIPIGPGRVFYTTEDIIGDIRQAHCNLSRAK
WNDTLKQIVIKLREQFG-NKTIVFNQSSGGDLEIVMHSFNCGGEFFYCNSTQLFNSTWF-
--NSTW------STEGSNNTE-GSDTITLPCRIKQIVNMWQGVGKAMYAPPIRGQTRCSS
NITGILLTRDGGTNGT----NETETFRPGGGNMKDNWRSELYRYKVVKIEPLGIAPTKAK
RRVVEREKRAIG-LGAMFLGFLGTAGSTMGAASLTLTVQARQLMSGIVQQQNNLLRAIEA
QQHMLKLTVWGIKQLQARVLALERYLKDQQLLGLWGCSGKLICTTTVPWNSSWSNKSQTD
IWDNMTWMQWDREISNYTNTIYRLLEDSQNQQEKNEKDLLALDSWKNLWNWFDITKWLWY
IKIFIMIVGGLIGLKIVFAVLSIINRVRQGYSPLSFQTLIPNPRGPDRPGGIEEEGGEQD
RDRSIRLVNGFLALIWVDLRSLFLFSYHRLRDLLLIVTRIVELLG-------RRGWEALK
YWWNLLQYWSQELKNSAINLLETIAIAVAEGTDRIIEVIQRICRAIRNIPTRIRQGLERA
LL-
>ENV-M.syn6.5
MRVKGIRKNYQHLWKWGTML--------LGMLMICSATEKLWVTVYYGVPVWKEATTTLF
CASDAKAYDTEVHNVWATYACVPTDPNPQELVLENVTENFDMWKNNMVEQMHEDIINLWD
QSLKPCVKLTPICVTLNCTDYVKNIT-NNATSTNSSW-GKPMEKGEIKNCSFNMTTELRD
KKQKVYSLFYKLDVVQM-DEDNTS----------YRLTSCNTSVITQACPKISFEPIPIH
YCTPAGYAILKCNDKNFNGTGPCKNVSSVQCTHGIKPVISTQLLLNGSLAEEEIIIRSEN
LTNNVKTIIVHLNKSVEINCTRPSNNTRTSIRIGPGQAFYATGDIIGDIRKAHCNISRAN
WNNTLRQIVEKLGEQFCNNKTIVFNHSSGGDPEITTHSFNCGGEFFYCNTTKLFNSTWTW
N-NSTW--N---NTKRSNDTE---EIITLPCRIKQIINMWQEVGKAMYAPPIQGVIRCES
NITGLILTRDGGNNN-----STNETFRPGGGDMRDNWRSELYKYKVVRIEPLGVAPTEAK
RRVVQREKRAVGTIGAMFLGFLGAAGSTMGAASVTLTVQARLLLSGIVQQQNNLLKAIEA
QQHLLRLTVWGIKQLQARVLAIERYLQDQQLLGIWGCSGKLICTTNVPWNTSWSNRSLNE
IWNNMTWMEWEKEIDNYTNLIYNLLEESQIQQEKNEQELLALDKWANLWNWFDISNWLWY
IRIFIIIVGGLVGLRIVFAVLSIVNKVRQGYSPLSFQTHLPAQRGPDRPEGIEEGGGEQD
RDRSVRLVDGFLAIIWVDLRSLCLFSYHHLRDLLLIVARIVELLG-------RRGWEVLK
YWWNLLKYWSQELKNSAVSLLNATAIAVAEGTDRIIELIQRICRAICNIPRRIRQGFERA
LL-
>ENV-M.syn6.6
MRVKETRKNYQHLWRWGIML--------LGMLMICSAAEQLWVTVYYGVPVWKEAKTTLF
CASNAKAYDTEAHNVWATHACIPTDPNPQEIVLENVTESFNMWKNDMVDQMHEDVISLWD
QSLKPCVQLTPLCVTLNCTN-VNVTNLKNETNTKSSSGGEKMEEGEMKNCSFNVTTELRD
KKKKEYALFYRLDIVPL-NEGNNSNSSY------YRLINCNTSTITQACPKVSFEPIPIH
FCAPAGFAILKCNDKKFNGTGPCKNVSTVQCTHGIKPVVSTQLLLNGSLAEKEIITRSEN
LTNNAKIIIVQLNESVEINCTRPGNNTRKSIRIGPGQTFYATGDIIGNIRQAHCNISRTQ
WNNTLKQIAIKLREQFG-NKTIIFNQSSGGDPEIVTHSFNCGGEFFYCKSTKLFNSTW--
---------N---STSLFNSTN---GTITLQCRIKQIINRWQEVGKAMYAPPIEGNITCKS
NITGLLLVRDGGINVTNN--TGTEVFRPGGGDMKDNWRNELYKYKVVEIKPLGVAPTRAR
RRVVEREKRAVG-LGAVFLGFLGAAGSTMGAAAVTLTVQARQLLFGIVQQQSNLLRAIEA
QQRMLQLTVWGIKQLQTRVLAIERYLKDQQLLGMWGCSGKLICTTAVPWNSSWSNKTYND
IWDNMTWLQWDKEISNYTDTIYRLLEESQNQQERNEKDLLELDKWASLWNWFNITNWLWY
IKIFIMTIGGLIGLRITFAVLSIVNRVRQGYSPLSFQTLTPNPRGPDRLGRIEEEGGEQD
KDRSIRLVNGFSALIWDDLRNLCLFSYHQLRDFILVTARAVELLGRSSLRGLQRGWEALK
YLGSLVQYWGLELKKSAISLLDTIAIAVANWTDRVIEVVQRAYRAILHIPTRIRQGFEAA
LQ-
```

Fig. 10 cont'd-13

```
>POL-B.syn1.1
FFRENLAFPQGKAREFSSEQTRANSPTRR--------------ELQVWGRDNNSLSEAGA
DR----QGTVS-FSFPQITLWQRPLVTIKIGGQLKEALLDTGADDTVLEEMNLPGRWKPK
MIGGIGGFIKVRQYDQIPIEICGHKAIGTVLVGPTPVNIIGRNLLTQIGCTLNFPISPIE
TVPVKLKPGMDGPKVKQWPLTEEKIKALVEICTEMEKEGKISKIGPENPYNTPVFAIKKK
DSTKWRKLVDFRELNKRTQDFWEVQLGIPHPAGLKKKKSVTVLDVGDAYFSVPLDKDFRK
YTAFTIPSINNETPGIRYQYNVLPQGWKGSPAIFQSSMTKILEPFRKQNPDTVTYQYMDD
LYVGSDLEIGQHRTKIEELRQHLLRWGFTTPDKKHQKEPPFLWMGYELHPDKWTVQPIVL
PEKDSWTVNDIQKLVGKLNWASQIYAGIKVKQLCKLLRGTKALTEVIPLTEEAELELAEN
REILKEPVHGVYYDPSKDLIAEIQKQGQGQWTYQIYQEPFKNLKTGKYARMRGAHTNDVK
QLTEAVQKIATESIVIWGKTPKFKLPIQKETWETWWTEYWQATWIPEWEFVNTPPLVKLW
YQLEKEPIVGAETFYVDGAANRETKLGKAGYVTDRGRQKVVSLTDTTNQKTELQAIHLAL
QDSGLEVNIVTDSQYALGIIQAQPDKSESELVSQIIEQLIKKEKVYLAWVPAHKGIGGNE
QVDKLVSAGIRKVLFLDGIDKAQEEHEKYHSNWRAMASDFNLPPVVAKEIVASCDKCQLK
GEAMHGQVDCSPGIWQLDCTHLEGKIILVAVHVASGYIEAEVIPAETGQETAYFLLKLAG
RWPVKTIHTDNGSNFTSTTVKAACWWAGIKQEFGIPYNPQSQGVVESMNKELKKIIGQVR
DQAEHLKTAVQMAVFIHNFKRKGGIGGYSAGERIVDIIATDIQTKELQKQITKIQNFRVY
YRDSRDPLWKGPAKLLWKGEGAVVIQDNSDIKVVPRRKAKIIRDYGKQMAGDDCVASRQD
ED-
>POL-B.syn3.1
FFRENLAFPQGKAREFPSEQTRANSPTSR--------------ELQVWGGDNNSLSEAGD
DR----QGTVS-FSFPQITLWQRPIVTIKIGGQQKEALLDTGADDTVLEEMNLPGRWKPK
IIGGIGGFIKVKQYDQILIEICGHKAIGTVLVGPTPANTIGRNLLTQIGCTLNFPISPIE
TVPVRLKPGMDGPKVKQWPLTEEKIKALIEICTELENEGKISKIGPENPYNTPVFAIKKK
DCTKWRKLVDFRELNKRTQDFWEVQLGIPHPAGLKKKKSVTVLDVGDAYFSVPLDKEFRK
YTAFTIPSINNETPGIRYQYNVLPQGWKGSPSIFQSSMTKILEPFRKQNPEIVIYQYMDD
LYVGSDLEIEQHRTKIEELRQHLLKWGFYTPDKKHQKEPPFLWMGYELHPDKWTVQPIVL
PEKDSWTVNDIQKLVGKLNWASQIYAGIKVKQLCRLLRGTKALTEVVPLTEEAELELAEN
REILKEPVHGVYYDPSKDLVAEIQKQGLGQWTYQIYQEPYKNLKTGKYAKMRGAHTNDVK
QLTEAVQKIATESIVIWGKTPKFRLPIQKETWEAWWMEYWQATWIPEWEFVNTPPLVKLW
YQLEKEPIVGAETFYVDGAANRDTKLGKAGYVTDRGRQKVVSLTDTTNQKTELQAIHLAL
QDSGLEVNIVTDSQYAIGIIQAQPDRSESELVSQIIEQLIKKEKVYLAWVPAHKGIGGNE
QVDKLVSSGIRKVLFLDGIDKAQEDHEKYHSNWKAMASDFNLPPVVAKEIVACCDKCQLK
GEAMHGQVDCSPGIWQLDCTHLEGKVTLVAVHVASGYIEAEVIPAETGQETAYFILKLAG
RWPVTTIHTDNGSNFTSTAVKAACWWAGIKQEFGIPYNPQSQGVVESINKELKKIIKQVR
DQAEHLKTAVQMAVFVHNFKRKGGIGGYSAGERMIDIIATDIQTTELQKQITKLQNFRVY
FRDSRDPLWKGPAKLLWKGEGAVVIQDNSEIKVVPRRKAKIIRDYGKQMAGDDCVASRQD
ED-
>POL-B.syn3.2
FFREDLAFLQGKAREFSSEQTRANSPTRG--------------ELQVWGRDNNSLSEAGA
DR----QGTVS-LSFPQITLWQRPLVTVKIGGQLKEALLDTGADDTVLEEMSLPGRWKPK
MIGGIGGFIKVRQYDQILVEICGHKAIGTVLIGPTPVNIIGRDLLTQIGCTLNFPISPID
TVPVKLKPGMDGPKVKQWPLTEEKIKALVEICTEMEKEGKTSKTGPENPYNTPIFAIKKK
DSTKWRKLVDFRELNRRTQDFWEVQLGIPHPAGLKQKKSVTVLDVGDAYFSVPLDEDFRK
YTAFTTPSTNNETPGIRYQYNVLPQGWKGSPAIFQSSMTRILEPFRKQNPDLVIYQYMDD
LYVGSDLEIGQHRTKIEELREHLLKWGFTTPDKKHQKEPPFLWMGYELHPDKWTVQPIML
PEKDSWTVNDIQKLVGKLNWASQIYPGIKVKQLCKLLRGAKALTEVIPLTKEAELELAEN
REILKEPVHGAYYDPSKDLIAEIQKQGQGQWTYQIYQDPFKNLKTGKYARMRGAHTNDVR
QLTEAVQKITTESIVIWGKTPKFKLPIQKETWETWWTEYWQATWIPEWEFVNTPPLVKLW
YQLEKEPIIGAETFYVDGAANRETKLGKAGYVTNKGRQKVVSITDTTNQKTELQAILLAL
QDSGLEVNIVTDSQYAIGIIQAQPDKSESELVSQIIEELIKKEKVYLTWVPAHKGIGGNE
QIDKLVSAGIRKVLFLDGIDQAQEEHEKYHSNWRAMASDFNIPPVVAKEIVASCDKCQLK
GEAIHGQVDCSPGIWQLDCTHLEGKIILVAVHVASGYIEAEIIPTETGQETAYFLLKLAG
RWPVKTVHTDNGSNFTSTTVKAACWWAGVKQEFGIPYNPQSQGVVESMNNELKKIIGQIR
DQAEHLKTAVQMAVFIHNFKRKGGIGGYSAGERIVDIIATDIQTKELQKQITKIQNFRVY
YRDNRDPLWKGPAKLLWKGEGAVVIQENSDIKVVPRRKVKTTRDYGKQMAGDDCVASGQD
ED-
```

Fig. 10 cont'd-14

```
>POL-B.syn3.3
FFREDLAFPQGEAREFSSEQTRANSPTRR--------------ELQVWGRDSNSLSEAGA
DR----QGTVS-FNFPQITLWQRPLVTIKIGGQLKEALLDTGADDTVLEDMNLPGKWKPK
MIGGIGGFIKVRQYDQIPIEICGHKAVGTVLVGPTPVNIIGRNLLTQLGCTLNFPISPIE
TVPVKLKPGMDGPKVKQWPLTEEKIKALVEICTELEKEGKISKIGPENPYNTPVFAIKKK
DSTKWRKVVDFRELNKKTQDFWEVQLGIPHPSGLKKKKSVTVLDVGDAYFSVPLDKDFRK
YTAFTIPSVNNETPGVRYQYNVLPQGWKGSPAIFQCSMTKILEPFRKQNPDIVIYQYMDD
LYVGSDLEIGQHRAKIEELRQHLLRWGFTTPDKKHQNEPPFLWMGYELHPDKWTVQPIEL
PEKDSWTVNDIQKLVGKLNWASQIYPGIKVRQLCKLLRGTKALTEVIPLTEEAELELAEN
REILREPVHGVYYDPTKDLIAEIQKQEQGQWTYQIYQEPFKNLKTGKYARTRGAHTNDVK
QLTEAVQKVATESIVIWGKTPKFKLPIQKETWEAWWTEYWQATWIPEWEFVNTPPLVKLW
YQLEKEPIEGAETFYVDGASNRETKLGKAGYVTNRGRQKVVPLTDTTNQKTELQAIYLAL
QDSGSEVNIVTDSQYALGIIQAQPDKSESELVNQIIEQLIKKEKIYLAWVPAHKGIGGNE
QVDKLVSAGIRKILFLDGIDKAQEEHEKYHNNWRAMASDFNLPPIVAKEIVASCDKCQLK
GEAIHGQVDCSPGIWQLDCTHLEGKVILVAVHVASGYIEAEVIPAETGQETAYFILKLAG
RWPVKTIHTDNGSNFTSATVKAACWWAGIKQEFGIPYNPQSQGVVESMNKELKKIIGQVR
DQAEHLKTAVQMAVFIHNFKRKGGIGEYSAGERIIDIIATDIQTRELQKQITKIQNFRVY
YRDSRDPLWKGPAKLLWKGEGAVVIQDNSDIKVVPRRKAKIIRDYGKQMAGDDCVAGRQD
ED- >POL-B.syn4.1
FFRENLAFPQGEAREFSSEQNRANSPTRR--------------ELQVWGGDNNSLSEAGA
DR----QGTVS-LSFPQITLWQRPLVTIRIGGQLKEALLDTGADDTVLEEMSLPGRWKPK
MIGGIGGFIKVRQYDQILIEICGHKAIGTVLIGPTPVNIIGRNILTQLGCTLNFPISPID
TVPVKLKPGMDGPKVKQWPLTEEKIKALVEICTEMEKEGKISKIGPENPYNTPIFAIKKK
DSTKWRKLVDFRELNRRTQDFWEVQLGIPHPSGLKKKKSVTVLDVGDAYFSVPLDKDFRK
YTAFTIPSINNETPGVRYQYNVLPQGWKGSPAIFQSSMTKILEPFRKQNPDMVIYQYMDD
LYVGSDLEIGQHRTKIEELRQHLLRWGLTTPDKKHQKEPPFLWMGYELHPDKWTVQPIKL
PEKDSWTVNDIQKLVGKLNWASQIYAGIKVRQLCKLLRGAKALTEVIPLTAEAELELAEN
REILREPVHGVYYDPSKDLIAEIQKQGQGQWTYQIYQDPFKNLKTGKYAKMRGAHTNDVK
QLTEAVQKVATESIVIWGKTPKFRLPIQKETWEAWWTEYWQATWIPEWEFVNTPPLVKLW
YQLEKEPIEGAETFYVDGAANRDTKLGKAGYVTDRGRQKVVSLTDTTNQKTELQAIHLAL
QDSGLEVNIVTDSQYALGIIQAQPDKSESELVSQIIEELIKKEKVYLAWVPAHKGIGGNE
QIDKLVSAGIRRVLFLDGIDQAQEEHEKYHSNWRAMASDFNLPPIVAKEIVASCDKCQLK
GEAIHGQVDCSPGIWQLDCTHLEGKIILVAVHVASGYIEAEVIPAETGQETAYFLLKLAG
RWPVKTIHTDNGSNFTSTTVKAACWWAGIKQEFGIPYNPQSQGVVESMNKELKKIIEQVR
DQAEHLKTAVQMAVFIHNFKRKGGIGEYSAGERIIDIIATDIQTRELQKQTTKIQNFRVY
YRDNRDPLWKGPAKLLWKGEGAVVIQDNSDIKVVPRRKAKIIRDYGKQMAGDDCVAGRQD
ED- >POL-B.syn4.2
FFRENLAFPQGKAREFPSEQTRANSPTSR--------------ELQVWGRDNNSLSEAGD
DR----QGTVS-FSFPQITLWQRPLVTVKIGGQLKEALLDTGADDTVLEEMNLPGRWKPK
MIGGIGGFIKVRQYDQIPIEICGHKAVGTVLVGPTPVNIIGRDLLTQIGCTLNFPISPIE
TVPVKLKPGMDGPKVKQWPLTEEKIKALIEICTELENEGKISKIGPENPYNTPVFAIKKK
DGTKWRKLVDFRELNKRTQDFWEVQLGIPHPAGLKQKKSVTVLDVGDAYFSVPLDKEFRK
YTAFTIPSTNNETPGIRYQYNVLPQGWKGSPAIFQCSMTKILEPFRKQNPDLVIYQYMDD
LYVGSDLEIEQHRTKIEELREHLLKWGFTTPDKKHQNEPPFLWMGYELHPDKWTVQPIML
PEKDSWTVNDIQKLVGKLNWASQIYAGIKVKQLCKLLRGTKALTEVVPLTEEAELELAEN
REILKVPVHGVYYDPSKDLVAEIQKQGLGQWTYQIYQEPFKNLKTGKYARTRGAHTNDVR
QLTEAVQKIATESIVIWGKTPKFKLPIQKETWEAWWMEYWQATWIPEWEFVNTPPLVKLW
YQLEKEPIVGAETFYVDGAANRETKLGKAGYVTDKGRQKVVPLTDTTNQKTELQAINLAL
QDSGSEVNIVTDSQYAIGIIQAQPDRSESELVSQIIEQLINKEKVYLAWVPAHKGIGGNE
QVDKLVSSGIRKVLFLDGIDKAQEDHEKYHSNWRAMAGDFNLPPVVAKEIVACCDKCQLK
GEAMHGQVDCSPGIWQLDCTHLEGKVILVAVHVASGYIEAEVIPAETGQETAYFILKLAG
RWPVKTVHTDNGSNFISTTVKAACWWAGVKQEFGIPYNPQSQGVVESMNNELKKIIGQVR
DQAEHLKTAVQMAVFVHNFKRKGGIGGYTAGERIVDIIASDIQTKELQKQITKIQNFRVY
```

Fig. 10 cont'd-15

```
YRDSRDPIWKGPAKLLWKGEGAVVIQDNSEIKVVPRRKAKIIRDYGKQMAGDDCVASRQN
ED-
>POL-B.syn4.3
FFREDLAFLQGKAREFSSEQTRANSPTRR--------------ELQVWGRDNNSPSEAGA
DR----QGTVS-FNFPQITLWQRPIVTIKIGGQLKEALLDTGADDTVLEDMNLPGKWKPK
MIGGIGGFIKVRQYDQILVEICGHKAIGTVLGPTPANIIGRNLLTQIGCTLNFPISPIE
TVPVKLKSGMDGPKVKQWPLTEEKIKALIEICTEMEKEGKISKIGPENPYNTPVFAIKKK
DSTKWRKLVDFRELNKRTQDFWEVQLGIPHPSGLKKKKSVTVLDVGDAYFSVPLDEDFRK
YTAFTIPSVNNETPGIRYQYNVLPQGWKGSPAIFQSSMTRILEPFRKQNPDIVIYQYMDD
LYVGSDLEIGQHRAKIEELRQHLLRWGFTTPDKKHQKEPPFLWMGYELHPDKWTVQPIEL
PEKDSWTVNDIQKLVGKLNWASQIYPGIKVRQLCKLLRGTKALTEVIPLTEEAELELAEN
REILKEPVHGVYYDPSKELIAEIQKQEQGQWTYQIYQEPFKNLKTGKYARMRGTHTNDVK
QLTEAVQKITTESIVIWGRTPKFKLPIQKETWESWWTEYWQATWIPEWEFVNTPPLVKLW
YQLEREPIAGAETFYVDGASNRETKLGKAGYVTNRGRQKVVSLPDTTNQKTELQAIYLAL
QDSGLEVNIVTDSQYAIGIIQAQPDKSESELVNQIIEQLIKKEKIYLAWVPAHKGIGGNE
QVDKLVSNGIRKILFLDGIDKAQDEHEKYHSNWKAMASDFNLPPVVAKEIVACCDKCQLK
GEAMHGQVDCSPGIWQLDCTHLEGKIILVAVHVASGYIEAEVIPAETGQETAYFLLKLAG
RWPVKIIHTDNGSNFTSTAVKAACWWAGIKQEFGIPYNPQSQGVVESINKELKKIIKQVR
DQAEHLKTAVQMAVFIHNFKRKGGIGGYSAGERMIDIIATDIQTTELQKQITKLQNFRVY
FRDSRDPLWKGPAKLLWKGEGAVVIQDNNDIKVVPRRKVKIIRDYGKQMAGDDCVASGQD
ED-
>POL-B.syn4.4
FFREDLAFPQGKARELSSEQTRANSPTRG--------------ELQVWGRDSNSLSEAGA
DR----PGTVS-FSFPQITLWQRPLVTIKIGGQQKEALLDTGADDTVLEEINLPGRWKPK
IIGGIGGFIKVKQYDQIPIEICGHKVIGTVLGPTPANIIGRNLLTQLGCTLNFPISPIE
TVPVRLKPGMDGPKVKQWPLTEEKTKALVEICTELEKEGKISKIGPENPYNTPVFAIKKK
DSTKWRKVVDFRELNKKTQDFWEVQLGIPHPAGLKKKKSVTVLDVGDAYFSVPLDENFRK
YTAFTIPSINNETPGIRYQYNVLPQGWKGSPSIFQSSMTKILEPFRKQNPEIVIYQYMDD
LYVGSDLELGQHRTKIEELRQHLLWGFYTPDKKHQKEPPFLWMGYELHPDKWTVQPIVL
PEKDSWTVNDIQKLVGKLNWASQIYPGIKVKQLCRLLRGAKALTEVIPLTKEAELELAEN
REILKEPVHGAYYDPTKDLIAEIQKQGEGQWTYQIYQEPYKNLKTGKYARMRGAHTNDVK
QLTETVQKITTESIVIWGKIPKFKLPIQKETWETWWTEYWQATWIPEWEFVNTPPLVKLW
YQLEKEPIIGAETFYVDGAASRETKLGKAGYVTNKGRQKVVSITDTTNQKTELQAILLAL
QDSGLEVNIVTDSQYAIGIIQAQPDKSESEIVSQIIEQLIKKEKVYLTWVPAHKGIGGNE
QVDKLVSAGIRKVLFLDGIDKAQEEHEKYHNNWRAMASDFNIPPVVAKEIVASCDCQLK
GEAMHGQVDCSPGIWQLDCTHLEGKVILVAVHVASGYIEAEIIPTETGQETAYFILKLAG
RWPVTTIHTDNGSNFTSATVKAACWWAGVKQEFGIPYNPQSQGVIESMNKELKKIIGQIR
DQAEHLKTAVQMAVFIHNFKRKGGIGGYSAGERIVDIIATDIQTKELQNQITKIQNFRVY
YRDSRDPLWKGPAKLLWKGEGAVVIQENSDIKVVPRRKVKIIRDYGKQMAGDDCVASRQD
ED-
>POL-B.syn6.1
FFREDLAFPQGEAREFCSEQTRANSPATR--------------ELQVWGRDNTSLSEAGA
DR----PGTVS-FSFPQITLWQRPIVTVKIEGQLKEALLDTGADDTVLEEMNLPGKWKPK
MIGGIGGFIKVRQYDQVSIEICGHKAICTVLGPTPANIIGRNLLTQIGCTLNFPISPIE
TVPVKLKPGMDGPKVKQWPLTEEKIKALVEICTELEKEGKISKIGPENPYNTPVFAIKKK
DSTKWRKVVDFRELNKRTQDFWEVQLGIPHPSGLKKKKSVTVLDVGDAYFSVPLDENFRK
YTAFTIPSINNETPGIRYQYNVLPQGWKGSPAIFQSSMTKILEPFRKQNPDIIIYQYMDD
LYVGSDLEIGQHRAKIEELRQHLLKWGFTTPDKKHQKEPPFLWMGYELHPDKWTVQPIEL
PEKDSWTVNDIQKLVGKLNWASQIYAGIKVKELCKLLRGTKALTEVVPLTEEAELELAEN
REILKEPVHGVYYDPSKDLIAELQKQGQGQWTYQIYQEPYKNLKTGKYARTRGAHTNDVR
QLTEAVQKIATEGIVIWGKTPKFKLPIQKETWEAWWTEYWQATWIPEWEFVNTPPLVKLW
YQLEKEPILGAETFYVDGASNRETKLGKAGYVTDRGRQKVVSLTDTTNQKTELQAINLAL
QDSGLEVNIVTDSQYALGIIQAQPDRSESELVSQIIEQLINKEKVYLAWVPAHKGIGGNE
QVDKLVSTGIRRVLFLDGIDKAQEEHEKYHSNWRAMASDFNLPPIVAKEIVASCDKCQLK
GEAIHGQVDCSPGIWQLDCTHLEGKVILVAVHVASGYIEAEVIPAETGQETAYFILKLAG
```

Fig. 10 cont'd-16

```
RWPVKTIHTDNGSNFTSTTVKAACWWAGIKQEFGIPYNPQSQGVVESMNKELKKIIEQVR
DQAEHLKTAVQMAVFVHNFKRKGGIGEYSAGERIVDIIATDIQTKELQKHITKIQNFRVY
YRDSRDPLWKGPAKLLWKGEGAVVIQDNSEIKVVPRRKAKIIRDYGKQMAGDDCVASRQD
ED-
>POL-B.syn6.2
FFREDLAFPQGKARELSSEQTRANSPTSPTRG-----------ELQVWGRDSNSLSEAGA
DR----QGPVS-FSFPQITLWQRPIVTIKIGGQLKEALLDTGADDTVLEDMNLPGRWKPK
MIGGIGGFIKVKQYDEILVEICGHKAIGTVLIGPTPVNIIGRNLLTQLGCTLNFPISPIE
TVPVKLKSGMDGPKVKQWPLTEEKIKALVEICTELEKEGKISKIGPENPYNTPIFAIKKK
DSTKWRKLVDFRELNKRTQDFWEVQLGIPHPAGLKKKKSVTVLDVGDAYFSVPLDKDFRK
YTAFTIPSVNNETPGIRYQYNVLPQGWKGSPAIFQCSMTKILEPFRKQNPDMVIYQYMDD
LYVGSDLEIGQHRIKIEELREHLLKWGFTTPDKKHQNEPPFLWMGYELHPDKWTVQPIVL
PEKDSWTVNDIQKLVGKLNWASQIYPGIKVRQLCKLLRGTKALTEVIPLTEEAELELAEN
REILREPVHGVYYDPTKDLIAEIQKQGQGQWTYQIYQEPFKNLKTGKYARMRGAHTNDVK
QITEAVQKITTESIVIWGKIPKFRLPIQKETWEAWWIEYWQATWIPEWEFVNTPPLVKLW
YQLEREPIAGAETFYVDGAANRETKLGKAGYVTNRGRQKVVSITDTTNQKTELQAILLAL
QDSGLEVNIVTDSQYALGIIQAPDKSESELVNQIIEQLIKKEKIYLAWVPAHKGIGGNE
QIDKLVSAGIRKVLFLDGIDKAQDEHEKYHSNWRAMAGDFNLPPVVAKEIVACCDKCQLK
GEAMHGQVDCSPGIWQLDCTHLEGKIILVAVHVASGYIEAEVIPAETGQETAYFLLKLAG
RWPVTTIHTDNGSNFTSATVKAACWWAGVKQEFGIPYNPQSQGVIESMNKELKKIIGQVR
DQAEHLKTAVQMAVFIHNFKRKGGIGEYSAGERIIDIIATDIQTKELQKQITKIQNFRVY
YRDSRDPIWKGPAKLLWKGEGAVVIQDNSEIKVVPRRKAKIIRDYGKQMAGDDCVAGRQD
ED-
>POL-B.syn6.3
FFRENLAFPQGEAREFSSEQTRANSPTRG---------------ELQVWGRDSNSLSEAGD
DR----QGTVS-FSFPQITLWQRPLVTTKIGGQQKEALLDTGADDTVLEEMNLPGRWKPK
IIGGIGGFIKVTQYDQIPIEICGHKAVGTVLVGPTPVNIIGRDLLTQIGCTLNFPISPIE
TVPVKLKSGMDGPKVKQWPLTEEKIKALIEICTEMEKEGKISKIGPENPYNTPVFAIKKK
DGTKWRKLVDFRELNKKTQDFWEVQLGIPHPAGLKQKKSVTVLDVGDAYFSVPLDREFRK
YTAFTIPSLNNETPGIRYQYNVLPQGWKGSPSIFQSSMTKILEPFRKQNPDLVIYQYMDD
LYVGSDLELGQHRTKIEELRQHLLKWGFYTPDKKHQKEPPFLWMGYELHPDKWTVQPIKL
PEKDSWTVNDIQKLVGKLNWASQIYPGIKVKQLCRLLRGAKALTEVVPLTKEAELELAEN
REILKEPVHGAYYDPTKDLIAEVQKQELGQWTYQIYQEPFKNLKTGKYARMKGAHTNDVK
QLTETVQKITTESIVIWGKTPKFRLPIQKETWESWWTEYWQATWIPEWEFVNTPPLVKLW
YQLEKEPITGAETFYVDGAANRETKIGKAGYVTDKGRQKVVSLPDTTNQKTELQAIHLAL
QDSGSEVNIVTDSQYAIGIIQAPDRSESEVVNQIIEQLIKKEKVYLAWVPAHKGIGGNE
QVDKLVSNGIRKILFLDGIDKAQEEHERYHSNWKAMASDFNLPPVVAKEIVACCDKCQLK
GEAIHGQVDCSPGIWQLDCTHLEGKVIILVAVHVASGYIEAEVIPAETGQETAYFILKLAG
RWPVKIIHTDNGSNFTSTAVKAACWWAGIKQEFGIPYNPQSQGVVESINKELKKIIKQVR
DQAEHLKTAVQMAVFIHNFKRKGGIGGYSAGERIIDIIASDIQTKELQNQITKIQNFRVY
YRDSRDPVWKGPAKLLWKGEGAVVIQDNSDIKVVPRRKAKIIRDYGKQMAGDDCVASRQN
ED-
>POL-B.syn6.4
FFRENLAFPQRKAREFSSEQTRANSPTRR---------------ELQVWGGDNNSLSEAGA
DR----QGTVS-LSFPQITLWQRPLVTIKVGGQLKEALLDTGADDTVLEEINLPGRWKPK
MIGGIGGFIKVRQYDQILVEICGHKAIGTVLVGPTPVNIIGRNLLTQIGCTLNFPISPIE
TVPVKLKPGMDGPKVKQWPLTEEKIKALVEICTEMEKEGKISKIGPENPYNTPIFAIKKK
DSTKWRKLVDFRELNRRTQDFWEVQLGIPHPAGLKKKKSVTVLDVGDAYFSVPLDEDFRK
YTAFTIPSINNETPGVRYQYNVLPQGWKGSPAIFQASMTKILEPFRKQNPDIVIYQYMDD
LYVGSDLEIGQHRIKIEELRQHLLRWGLTTPDKKHQKEPPFLWMGYELHPDKWTVQPIML
PEKDSWTVNDIQKLVGKLNWASQIYAGIKVRQLCKLLRGAKALTEVIPLTAEAELELAEN
REILKVPVHGVYYDPSKELIAEIQKQEQGQWTYQIYQDPFKNLKTGKYARMRGTHTNDVR
QLTEAVQKIPTESIVTWGKIPKFKLPIQKETWETWWTEYWQATWIPEWEFVNTPPLVKLW
YQLEKEPIIGAETFYVDGAASRETKLGKAGYVTDRGRQKVISLTDTTNQKTELQAIHLAL
QDSGVEVNIVTDSQYALGIIQAPDKSESEIVSQIIEQLIKKEKVYLTWVPAHKGIGGNE
```

Fig. 10 cont'd-17

```
QVDKLVSTGIRKVLFLDGIDQAQEEHEKYHSNWRTMASDFNLPPIVAKEIVASCDKCQLK
GEAMHGQVDCSPGIWQLDCTHLEGKVILVAVHVASGYIEAEVIPAETGQETAYFLLKLAG
RWPVKTIHTDNGPNFISTTVKAACWWAGIKQEFGIPYNPQSQGVVESMNNELKKIIGQVR
EQAEHLKTAVQMAVFIHNFKRKGGIGGYSAGERMIDIIATDIQTTELQKQITKLQNFRVY
FRDSRDPLWKGPAKLLWKGEGAVVIQENSDIKVVPRRKAKIIRDYGKQMAGDDCVAGRQD
ED-
>POL-B.syn6.5
FFRENLAFPQGKAREFPSEQTRANSPTSR--------------ELQVWGRDNNSLSEAGA
NR----QGTVS-FSFPQITLWQRPLVTVKIGGQLKEALLDTGADDTVLEDMDLPGRWKPK
MIGGIGGFIKVRQYDQIPIEICGHKVIGTVLVGPTPANIIGRNLLTQIGCTLNFPISPIE
TVPVRLKPGMDGPKVKQWPLTEEKIKALVEICTELEKEGKISKIGPENPYNTPVFATKKK
DSTKWRKLVDFRELNKKTQDFWEVQLGIPHPSGLKKKKSVTVLDVGDAYFSVPLDKEFRK
YTAFTIPSTNNETPGIRYQYNVLPQGWKGSPAIFQASMTKILEPFRKQNPEIVIYQYMDD
LYVGSDLEIEQHRTKIEELRQHLLRWGFTTPDKKHQKEPPFLWMGYELHPDKWTVQPIVL
PDKDSWTVNDIQKLVGKLNWASQIYPGIKIRQLCKLLRGAKALTEVIPLTKEAELELAEN
REILKEPVHGVYYDPSKDLIAEIQKQGEGQWTYQIYQEPFKNLKTGKYAKMRGAHTNDVK
QLTEAVQKVATESIVIWGKTPKFKLPIQKETWEAWWMEYWQATWIPEWEFVNTPPLVKLW
YQLEKEPIEGAETFYVDGAANRDTKLGKAGYVTNKGRQKVVTLTDTTNQKTELQAIHLAL
QDSGLEVNIVTDSQYALGIIQAQPDKSESEIVNQIIEQLIKKEKVYLAWVPAHKGIGGNE
QVDKLVSSGIRKVLFLDGIDKAQEDHEKYHSNWRAMANDFNLPPVVAKEIVACCDKCQLK
GEAMHGQVDCSPGIWQLDCTHLEGKVILVAVHVASGYIEAEVIPAETGQETAYFILKLAG
RWPVKTVHTDNGSNFTSNTVKAACWWAGIKQEFGIPYNPQSQGVVESMNKQLKQIIGQVR
DQAEHLKTAVQMAVFIHNFKRKGGIGGYTAGERIVDIIATDIQTRELQKQITKIQNFRVY
YRDSREPLWKGPAKLLWKGEGAVVIQDNSDIKVVPRRKAKIIRDYGKQMAGDDCVASGQD
ED-
>POL-B.syn6.6
FFREDLAFLQGKAREFSSEQTRAISPTRR--------------ELQVWGRDNNSPSEAGA
DR----QGTVS-FNFPQITLWQRPLVTIRIGGQLKEALLDTGADDTVLEEMSLPGRWKPK
MIGGIGGFIKVRQYDQILIEICGHKAVGTVLIGPTPVNIIGRNLLTQIGCTLNFPISPID
TVPVKLKPGMDGPKVKQWPLTEEKIKALIEICTELENEGKISKIGPENPYNTPIFAIKKK
DSTKWRKLVDFRELNKRTQDFWEVQLGIPHPSGLKKKKSVTVLDVGDAYFSIPLDEDFRK
YTAFTIPSINNETPGTRYQYNVLPQGWKGSPAIFQSSMTRILEPFRKQNPDIVIYQYVDD
LYVGSDLEIGQHRTKIEELREHLLRWGFTTPDKKHQKEPPFLWMGYELHPDKWTVQPITL
PEKDSWTVNDIQKLVGKLNWASQIYAGIKVKQLCKLLRGTKSLTEVVPLTAEAELELAEN
REILKEPVHGAYYDPSKDLVAEIQKQGLGQWTYQIYQEPFKNLKTGKYAKMRGTHTNDVK
QLTEAVQKIATESIVIWGRTPKFKLPIQKETWDAWWTEYWQATWIPEWEFVNTPPLVKLW
YQLEKEPIVGAETFYVDGAANRETRLGKAGYVTDRGRQKVVPLTDTTNQKTELQAIYLAL
QDSGLEVNIVTDSQYALGIIQAQPDKSESELVSQIIEELIKKEKVYLAWVPAHKGIGGNE
QVDKLVSAGIRRVLFLDGIDKAQEEHEKYHNNWRAMASDFNIPPVVAKEIVASCDKCQLK
GEAIHGQVDCSPGIWQLDCTHLEGKIILVAVHVASGYIEAEIIPTETGQETAYFLLKLAG
RWPVKTIHTDNGRNFTSNSVKAACWWAGIKQEFGIPYNPQSQGVVESMNRELKKIIGQIR
DQAEHLKTAVQMAVFIHNFKRKGGIGGYSAGERIVDIIASDIQTKELQKQITKIQNFRVY
YRDNRDPLWKGPAKLLWKGEGAVVIQDNNDIKVVPRRKVKIIRDYGKQMAGDDCVASRQD
ED- >POL-C.syn1.1
FFRENLAFPQGEAREFPSEQTRANSPTSRANSPTSR-------ELQV--RGDNPRSEAGA
ER----QGT---LNFPQITLWQRPLVSIKVGGQIKEALLDTGADDTVLEEINLPGKWKPK
MIGGIGGFIKVRQYDQILIEICGKKAIGTVLVGPTPVNIIGRNMLTQLGCTLNFPTSPIE
TVPVKLKPGMDGPKVKQWPLTEEKIKALTAICEEMEKEGKITKIGPENPYNTPVFAIKKK
DSTKWRKLVDFRELNKRTQDFWEVQLGIPHPAGLKKKKSVTVLDVGDAYFSVPLDECFRK
YTAFTIPSINNETPGIRYQYNVLPQGWKGSPAIFQSSMTKILEPFRAQNPEIVIYQYMDD
LYVGSDLEIGQHRAKIEELREHLLKWGFTTPDKKHQKEPPFLWMGYELHPDKWTVQPIQL
PEKDSWTVNDIQKLVGKLNWASQIYPGIKVRQLCKLLRGAKALTDIVPLTEEAELELAEN
REILKEPVHGVYYDPSKDLIAEIQKQGHDQWTYQIYQEPFKNLKTGKYAKMRTAHTNDVK
```

Fig. 10 cont'd-18

```
QLTEAVQKIAMESIVIWGKTPKFRLPIQKETWETWWTDYWQATWIPEWEFVNTPPLVKLW
YQLEKEPIAGAETFYVDGAANRETKIGKAGYVTDRGRQKIVSLTETTNQKTELQAIQLAL
QDSGSEVNIVTDSQYALGIIQAPDKSESELVNQIIEQLIKKERVYLSWVPAHKGIGGNE
QVDKLVSSGIRKVLFLDGIDKAQEEHEKYHSNWRAMASEFNLPPIVAKEIVASCDKCQLK
GEAIHGQVDCSPGIWQLDCTHLEGKIILVAVHVASGYIEAEVTPAETGQETAYYILKLAG
RWPVKVIHTDNGSNFTSAAVKAACWWAGIQQEFGIPYNPQSQGVVESMNKELKKIIGQVR
DQAEHLKTAVQMAVFIHNFKRKGGIGGYSAGERIIDIIATDIQTKELQKQIIKIQNFRVY
YRDSRDPIWKGPAKLLWKGEGAVVIQDNSDIKVVPRRKVKIIKDYGKQMAGADCVAGRQD
EDQ
>POL-C.syn3.1
FFRENLAFPQGEAREFPPEQTRANSPT-RANSPTSR-------KLQV--RGDNPCSEAGA
ER----QGT---FNFPQITLWQRPLVTIKVGGQVKEALLDTGADDTVLEEINLPGKWKPK
MIGGIGGFIKVRQYDQIVIEICGKKAIGTVLIGPTPVNIIGRNMLTQLGCTLNFPISPIE
TVPVKLKPGMDGPKIKQWPLTEEKIKALTAICDEMEKEGKIEKIGPENPYNTPIFAIKKK
DSTKWRKLVDFKELNKRTQDFWEVQLGIPHPAGLKKKRSVTVLDVGDAYFSVPLDESFRK
YTAFTIPSINNETPGIRYQYNVLPQGWKGSPAIFQSSMTRILEPFRAKNPEIVIYQYMDD
LYIGSDLEIGQHRAKVEELREHLLRWGFTTPDKKHQKEPPFLWMGYELHPDKWTVQPIQL
PEKDSWTVNDIQRLVGKLNWASQIYPGIKVRQLCKLLRGTKALTDIVPLTEEAELELAEN
REILKEPVHGVYYDPSKDLIAEIQKQGDDQWTYQIYQESFKNLKTGKYAKMRSAHTNDVK
QLTEAVQKIALESIVIWGKAPKFRLPIQKETWEIWWTDYWQATWIPDWEFVNTPPLVKLW
YQLEKEPIAGAETFYVDGAANRETKIGKAGYVTDRGRQKVVTLTETTNQKTELQAIQLAL
QDSGLEVNIVTDSQYALGIIQAPDKSESELVNQIIEELIKKERVYLSWVPAHKGIGENE
QVDKLVSNGIRKVLFLDGIDKAQEEHEKYHSNWRAMANEFNLPPVVAKEIVASCDKCQLK
GEAIHGQVDCSPGMWQLDCTHLEGKVILVAVHVASGYVEAEVIPAETGQETAYFILKLAG
RWPVKIIHTDNGSNFTSNAVKAACWWAGIQQEFGIPYNPQSQGVVESMNKELKKIIGQVR
EQAEHLKTAVQMAVFIHNFKRRGGIGGYSAGERIIDITASDIQTKELQKQITKIQNFRVY
YRDSRDPVWKGPAKLLWKGEGAVVIQDNGDIKVVPRRKAKIIKDYGKQMAGDDCVAGRQD
EDQ
>POL-C.syn3.2
FFRENLAFQQGEAREFPSEQTRANSPTSRANSPTSRTNSPTSRELQV--RGDNPRSEAGV
ER----QGT----LNFPQITLWQRPLVSIKVGGQIKEALLDTGADDTVLEDINLPGKWKPR
MIGGIGGFIKVRQYDQIPIEICGKKAIGTVLVGPTPVNIIRRNMLTQLRCTLNFPISPIK
TVPVKLKPGMDGPKVKQWPLTEEKIKALTEICEEMEKEGKITKIGPENPYNTPVFAIKKK
DSTKWRKLVDFRELNKRTQDFWEVQLGIPHPSGLKKKKSVTVLDVEDAYFSVPLDEGFRK
YTAFTIPSTNNETPGIRYQYNVLPQGWKGSPAIFQCSMTKILEPFRTQNPDIVIYQYMDD
LYVGSDLEIGQHRAKIEELRAHLLKWGLTTPDKKHQKEPPFLWMGYELHPDKWTVQPIKL
PEKDSWTVNDIQKIVGKLNWASQIYPGIKVKQLCKLLRGAKALTDIIPLTEEAELELAEN
REILKEPVHGAYYDPSKDLVAEIQKQGHDQWTYQIYQEPYKNLKTGKYAKMRTAHTNDVR
QLTEAVQKIAQESIVIWGKTPKFRLPIQKETWETWWTDYWQATWIPEWEFINTPPLVKLW
YQLEKEPIVGAETFYVDGAANRETKMGKAGYVTDKGRQKIVSLTETTNQKAELQAIQLAL
QDSGPEVNIVTDSQYALGIIQAPDRSESELVNQIIEQLINKERIYLSWVPAHKGIGGNE
QVDKLVSSGIRKVLFLDGIDKAQEDHEKYHNNWRAMASDFNLPPIVAREIVASCDKCQLK
GEAMHGQVDCSPGVWQLDCTHLEGKIILVAVHVASGYMEAEVIPAETGQETAYYILKLAG
RWPVKVIHTDNGSNFTSTAVKAACWWAGIKQEFGIPYNPQSQGVVEAMNKELKKIIEQVR
DQAEHLKTAVQMAVLIHNFKRKGGIGGYSAGERIVDIIATDIQTRELQKQIIQIQNFRVY
YRDSRDPIWKGPAKLLWKGEGAVVIQDNSDIKVVPRRKVKIIKDYGKQMAGADCVASRQD
ED-
>POL-C.syn3.3
FFRENLAFPQGKAREFPSEQARANSPTSRANSPTSR-------ELQV--RRDNPRSEAGA
ER----QCT---LNCPQITLWQRPLVSIKIGGQTREALLDTGADDTVLEEISLPGKWKPK
MIGGIGGFIKVRQYDQILIEICGKKAIGSVLVGPTPVNIIGRNLLTQLGCTLNFPISPIE
TIPVKLKPGMDGPRVKQWPLTEEKIKALTAICEEMEKEGKISKIGPENPYNTPIFAIKKK
DSTKWRKLVDFREINKRTQDFWEIQLGIPHPAGLKKKKSVTVLDVGDAYFSVPLDEDFRK
YTAFTIPSINNATPGIRYQYNVLPQGWKGSPSIFQSSMTKILEPFRAQNPEIVIYQYMDD
LYVGSDLEIEQHRAKIEELREHLLKWGFTTPDKKHQKEPPFLWMGCELHPDKWTVQPIQL
```

Fig. 10 cont'd-19

```
PEKESWTVNDIQKLVGKLNWASQIYAGIKVKQLCRLLRGAKALTDIVPLTAEAELELAEN
REILREPVHGVYYDPSKELIAEIQKQGQDWTYQIYQEPFKNLKTGKYAKRRTAHTNDVK
QLAEAVQKIAMESIVIWGKIPKFRLPIQKETWEAWWTDYWQATWIPEWEFVNTPPLVKLW
YQLEKDPIAGVETFYVDGAANRETKLGKAGYVTDRGRQKIVSLSETTNQKTELHAIQLAL
QDSGSEVNIVTDSQYALRIIQAQPDKSESEIVNQIIEQLIKKERVYLAWVPAHKGIGENE
QVDKLVSKGIRKVLFLDGIEKAQEEHERYHSNWRAMASEFNLPPIVAKEIVASCDKCQLK
GEATHGQVDCSPGIWQLDCTHLEGKVIIVAVHVASGYIEAEVIPAETGQETAYFLLKLAG
RWPVKTTHTDNGSNFTSAAVKAACWWAGIHQEFGIPYNPQSQGVVESMNKELKKIIGQVR
DQAEHLKTAVLMAVFIHNFKRKGGIGDYSAGERIIDIIATDIQTKELQKQITKTQNFRVY
YRDNRDPIWKGPAKLLWKGEGAVVLQDNSDIKVIPRRKAKIIRDYGKQMAGADCVAGRQD
ENQ

>POL-C.syn4.1
FFRENLAFPQGKAREFPSEQARANSPTSRANSPTSR-------ELQV--RRDNPRSEAGA
ER----QGT---LNLPQITLWQRPLVSIKVGGQIKEALLDTGADDTVLEDINLPGKWKPK
MIGGIGGFIKVRQYDQIPIEICGKKAIGTVLVGPTPVNIIGRNMLTQLGCTLNFPISPIE
TIPVKLKPGMDGPKVKQWPLTEEKIKALTEICKEMEKECKIEKIGPENPYNTPVFAIKKK
DSTKWRKLVDFRELNKRTQDFWEVQLGIPHPSGLKKKKSVTVLDVEDAYFSVPLDENFRK
YTAFTIPSVNNETPGIRYQYNVLPQGWKGSPAIFQCSMTKILEPFRTQNPEIVIYQYMDD
LYVGSDLEIGQHRAKIEKLREHLLKWGFTTPDKKHQKEPPFLWMGYELHPDKWTVQPIKL
PEKDSWTVNDIQRLVGKLNWASQIYAGIKVRQLCKLLRGAKALTDIVPLTKEAELELAEN
REILKEPVHGVYYDPSKELIAEIQKQGQDQWTYQIYQEPFKNLKTGKYAKRRTAHTNDVK
QLAEAVQKITMESIVIWGRTPKFRLPIQKETWEAWWTDYWQATWIPEWEFVNTPPLVKLW
YQLEKEPIAEAETFYVDGAANRETKMGKAGYVTDKGRQKIVSLTETTNQKTELHAIQLAL
QDSGPEVNIVTDSQYALGIIQAQPDKSESELVSQIIEQLINKERIYLSWVPAHKCIGGNE
QVDKLVSKGIRKVLFLDGIDKAQEEHERYHSNWRAMANEFNLPPIVAREIVASCDKCQLK
GEATHGQVDCSPGVWQLDCTHLEGKIILVAVHVASGYVEAEVIPAETGQETAYFLLKLAG
RWPVKTIHTDNGSNFTSAAVKAACWWAGVQQEFGIPYNPQSQGVVESMNKELKKIIGQIR
DQAEHLKTAVQMAVFIHNFKRKGGIGDYSAGERIIDIIATDIQTRELQKQIIQIQNFRVY
YRDSRDPVWKGPAKLLWKGEGAVVLQDNSDIKVVPRRKVKIIKDYGKQMAGADCVAGRQD
ENQ
>POL-C.syn4.2
FFRENLAFPEGEAREFPSEQTRANSPT-RANSPTSR-------KLQV--RGDNPRSEAGV
ER----QGT---LNFPQITLWQRPLVSIKIGCQTREALLDTGADDTVLEEIKLPGNWKPK
MIGGIGGFIKVRQYDQILIEICGKKATGTVLIGPTPVNIIGRNLLTQLGCTLNFPISPIK
TVPVKLKPGMDGPKVKQWPLSEEKIKALTEICEEMEKEGKISKIGPENPYNTPVFAIKKK
DSTKWRKLVDFRELNKRTQDFWEIQLGIPHPAGLKKKKSVTVLDVGDAYFSVPLDEDFRK
YTAFTIPSINNATPGIRYQYNVLPQGWKGSPSIFQSSMTKILEPFRAKNPEIVIYQYMDD
LYVGSDLEIGQHRAKVEELREHLLKWGLTTPDKKHQKFPPFLWMGYELHPDKWTVQPIQL
PDKDSWTVNDIQKLVGKLNWASQIYFGIKVKQLCKLLRGTKALTDIVPLTAEAELELAEN
REILREPVHGVYYDPSKDLVAEIQKQGNDQWTYQIYQEPYKNLKTGKYAKMRSAHTNDVK
QLTEAVQKIALESIVIWGKAPKFRLPIQKETWEIWWTDYWQATWIPDWEFVNTPPLVKLW
YQLEKDPIAGVETFYVDGAANRETKLGKAGYVTDRGRQKIVSLSETTNQKTELQAIQLAL
QDSGLEVNIVTDSQYALGIIQAQPDKSESELVNQIIEELIKKEKVYLSWVPAHKGIGENE
QVDKLVSSGTRKVLFLDGIEKAQEEHEKYHNNWRAMASEFNLPPIVAKEIVASCDKCQLK
GEATHGQVDCSPGMWQLDCTHLEGKIIIVAVHVASGYLEAEVIPAETCQDTAYYILKLAG
RWPVKVIHTDNGTNFTSAAVKAACWWAGIQQEFGIPYNPQSQGVVESMNKELKKTIGQVR
EQAEHLKTAVLMAVFIHNFKRKGGICEYSAGERIIDMIATDIQTKELQNQITKIQNFRVY
YRDSRDPIWKGPAKLLWKGEGAVVIQDNGDIKVVPRRKVKIIRDYGKQMAGDDCVAGRQD
EDQ
>POL-C.syn4.3
FFRENLAFPQGEAREFPPEQTRANSPTSRTNSPTSR-------ELQV--RGDNPRSEAGA
ERQGTLQGT---LNCPQITLWQRPLVSIRVGGQIKEALLDTGADDTVLEEISLPGKWKPK
MIGGIGGFIKVRQYDQIVIEICGKKAIGSVLVGPTPVNIIRRNMLTQLRCTLNFPISSIE
TVPVKLKPGMDGPRVKQWPLTEEKIKALTAICEEMEKEGKITKIGPDNPYNTPVFAIKKK
```

Fig. 10 cont'd-20

```
DSTKWRKLVDFKELNKRTQDFWEVQLGIPHPAGLKRKKSVTVLDVGDAYFSVPLDEGFRK
YTAFTIPSTNNETPGIRYQYNVLPQGWKGSPAIFQSSMIKILEPFRAQNPDIVIYQYMDD
LYIGSDLEIGQHRAKIEELRAHLLKWGFTTPDKKHQKEPPFLWMGCELHPDKWTVQPIQL
PEKESWTVNDIQRLVGKLNWASQIYSGIKVRQLCKLLRGVKALTDIVPLTEEAELELAEN
REILKETVHGAYYDPSKDLIAEIQKQGHDQWTYQIYQEPFKNLKTGKYAKMRTAHTNDIK
QLTEAVQKIAMESIVIWGKTPKFRLPIQKETWETWWTDYWQATWIPEWEFINTPPLVKLW
YQLEKEPIVGAETFYVDGAANRDTKLGKAGYITDRGRQKVVTLTETTNQKAELQAIQLAL
QDSGSKVNIVTDSQYALGIIQAQPDRSESELVNQTTEQLTKKERVYLSWVPAHKGIGGNE
QIDKLVSSGIRRVLFLDGIDKAQEDHEKYHSNWRAMASDFNLPPIVAKEIIASCDKCQLK
GEAMHGQVDCSPGIWQLDCTHLEGKVIIVAVHVASGYIEAEVIPAETGQETAYYILKLAG
RWPVKIIHTDNGSNFTSNAVKAACWWAGIHQEFGIPYNPQSQGVVFAMNKELKKIIGQVR
DQAEHLKTAVLMAVFIHNFKRRGGIGGYSAGERIIDIIASDIQTKELQKQITKIQNFRVY
YRDSRDPIWKGPAKLLWKGEGAVVIQDNSDIKVIPRRKAKIIKDYGKQMAGADCVAGGQD
EN-
>POL-C.syn4.4
FFRENLAFQQGEAREFPSEQTRAISPTSR--------------ELQV--RGDNPCSEAGA
ER----QGT---FNFPQITLWQRPLVTIKVGGQVKEALLDTGADDTVLEEINLPGKWKPR
MIGGIGGFIKVRQYEQILIEICGKRAIGTVLVGPTPINIIGRNMLTQIGCTLNFPISPIE
TVPVKLKPGMDGPKIKQWPLTEEKIKALTAICDEMEKEGKITKIGPENPYNTPIFAIKKK
DSTKWRKLVDFRELNKRTQDFWEVQLGIPHPAGLKKKRSVTVLDVGDAYFSVPLDESFRK
YTAFTIPSINNETPGTRYQYNVLPQGWKGSPAIFQSSMTRILEPFRAQNPEIVIYQYMDD
LYVGSDLEIEQHRAKIEELREHLLRWGFTTPDKKHQKEPPFLWMGYELHPDKWTVQPIQL
PEKDSWTVNDIQKIVGKLNWASQIYPGIKVRQLCRLLRGAKALTDIIPLTEEAELELAEN
REILKEPVHGAYYDPSKDLIAEIQKQGDDQWTYQIYQESFKNLKTGKYAKMRTAHTNDVR
QLTEAVQKIAQESIVIWGKIPKFRLPIQKDTWETWWTDYWQATWIPDWEFVNTPPLVKLW
YQLEKEPIAGAETFYVDGAANRETKIGKAGYVTDRGRQKVITLTETTNQKTELQAIHLAL
QDSGSEVNIVTDSQYALRITQAQPDKSESEIVNQIIEQLINKERVYLSWVPAHKGIGGNE
QVDKLVSNGIRKVLFLDGIDKAQEEHEKYHSNWRAMASEFNLPPVVAKEIVASCDKCQQK
GFAIHGQVDCSPRIWQLDCTHLEGKVILVAVHVASGYMEAEVIPAETGQETAYFILKLAG
RWPVKVIHTDNGSNFTSTAVKAACWWAGIKQEFGIPYNPQSQGVVESMNKELKKIIEQVR
DQAEHLKTAVQMAVLIENFKRKGGIGGYSAGERIVDIIATDIQTKELQKQIIKIQNFRVY
YRDNRDPIWKGPAKLLWKGEGAVVIQDNSEIKVVPRRKAKIIRDYGKQMAGADCVASRQD
ED-
>POL-C.syn6.1
FFRENLAFPQGKAREFPSEQTRAISPTSR--------------ELQV--RGNNPRSEAGA
ER----QGT---LNLPQITLWQRPLVSIKIGGQTREALLDTGADDTVLEEIKLPGNWKPK
MIGGIGGFIKVRQYDQILIEICGKRAIGTVLVGPTPVNIIGRNMLTQIGCTLNFPISSIE
TVPVKLKPGMDGPKVKQWPLTEEKIKALTEICEEMEKEGKITKIGPDNPYNTPVFAIKKK
DSTKWRKLVDFKELNKRTQDFWEVQLGIPHPAGLKKNKSVTVLDVGDAYFSVPLDESFRK
YTAFTIPSINNETPGIRYQYNVLPQGWKGSPAIFQSSMTRILEPFRAQNPDIVIYQYMDD
LYVGSDLEIEQHRAKIEELREHLLRWGFTTPDKKHQKEPPFLWMGCELHPDKWTVQPIQL
PEKDSWTVNDIQKLVGKLNWASQIYSGIKVRQLCKLLRGVKALTDIVPLTKEAELELAEN
REILREPVHGVYYDPAKDLTAEIQKQGQDQWTYQIYQEPFKNIKTGKYAKRRTAHTNDVK
QLTEAVQKIATESIVIWGKIPKFRLPIQKDTWETWWTDYWQATWIPDWEFVNTPPLVKLW
YQLEKEPIAEAETFYVDGAASRETKMGKAGYVTDRGRQKVITLTETTNQKTELQAIKLAL
QDSGSEVNVVTDSQYALGIIQAQPDKSESEIVNQIIEQLINKERVYLSWVPAHKGIGGNE
QVDKLVSRGIRKVLFLDGIDKAQDEHEKYHSNWRAMASEFNLPPIVAREIVASCDKCQLK
GEATHGQVDCSPGIWQLDCTHLEGKIILVAVHVASGYIEAEVIPTETGQETAYYILKLAG
RWPVKIIHTDNGSNFTSSAVKAACWWAGIQQEFGIPYNPQSQGVVESMNKELKKIIGQVG
DQAEHLKTAVQMAVFIHNFKRRGGIGGYSAGERIIDIIATDIQTRELQKQIIKIQNFQVY
YRDSRDPIWKGPAKLLWKGEGAVVIQDNSEIKVVPRRKVKIIKDYGKQMAGADCMASRQD
ED-
>POL-C.syn6.2
FFRENLAFPQGEARELPSEQTRANGPTSR--------------ELQV--RGDNPCSEAGA
ER----QGT---FNFPQITLWQRPLVTIKVGGQVKEALLDTGADDTVLEEINLPGKWKPK
```

Fig. 10 cont'd-21

```
MIGGIGGFIKVRQYDQIPIEICGKRAIGTVLVGPTPINIIGRNMLTQLGCTLNFPISPIE
TVPVQLKPGMDGPRVKQWPLTEEKIKALTEICKEMEKEGKISKIGPENPYNTPIFAIKKK
DSTKWRKLVDFRELNKRTQDFWEVQLGIPHPAGLKKKRSVTVLDVGDAYFSVPLDEDFRK
YTAFTIPSINNETPGVRYQYNVLPQGWKGSPSIFQSSMTKILEPFRTQNPEIVIYQYMDD
IYIGSDLEIGQHREKIEELREHLLKWGFTTPDKKHQKEPPFLWMGYELHPDKWTVQPIKL
PEKDSWTVNDIQRLVGKLNWASQIYAGTKVRQLCKLLKGAKALTDIVTLTEEAELELAEN
REILKEPVYGVYYDPSKDLVAEIQKQGNDQWTYQIYQESFKNLKTGKYAKMRTAHTNDIK
QLTEAVQKIAQESIVIWGKTPKFRLPIQKETWEAWWTDYWQATWIPDWEFVNTPPLVKLW
YQLEKEPMAGVETFYVDGAANRETKIGKAGYVTDRGRQKVVTITETTNQKTELQAIYLAL
QDSGSKVNIVTDSQYALGIIQAPDKSESELVSQIIEQLINKEKIYLSWVPAHKGIGGNE
QVDKLVSSGIRKVLFLDGIDKAQEDHERYHSNWRAMASDFNLPPIVAKEIVASCDQCQLK
GEAMHGQVDCSPGMWQLDCTHLEGKIIIVAVHVASGYIEAEVISAETGQETAYYILKLAG
RWPVKVVHTDNGSNFTSAAVKAACWWAGVQQEFGIPYNPQSQGVVESMNKELKRIIGQVR
DQAEHLKTAVQMAVFIHNFKRKGGIGGYSAGERIIDMIATDIQTKELQKQIIQIQNFRVY
YRDSRDPIWKGPAKLLWKGEGAVVIQDKGDIKVVPRRKAKIIRDYGKQMAGADCMAGRQD
EDQ
>POL-C.syn6.3
FFREDLAFPQGEARKFPPEQTRANSPTSRANSPTSR-------KLQV--RGDNPRSEAGV
ER----QGT---LNFPQITLWQRPLVSIKVGGQIREALLDTGADDTVLEEMSLPGKWKPK
MIGGIGGFIKVKQYEQILIEICGKKAIGSVLVGPTPVNIIGRNLLTQLGCTLNFPISPIE
TVPVKLKPGMDGPKVQWPLTEEKIKALTAICDEMEKEGKITKIGPENPYNTPVFAIKKK
DSTKWRKLVDFKELNKRTQDFWEVQLGIPHPAGLKKKKSVTVLDVGDAYFSVPLDENFRK
YTAFTIPSRNNETPGIRYQYNVLPQGWKGSPAIFQASMTKILEPFRAKNPEIVIYQYMDD
LYVGSDLEIGQHRAKIEELRDHLLKWGFTTPDKKHQKEPPFLWMGYELHPDKWTVQPIEL
PEKDSWTVNDIQKLVGKLNWASQIYPGIQVKQLCKLLRGAKALTDVVPLTEEAELELAEN
REILKEPVHGAYYDPSKDLIAEIQKQGHDQWTYQIYQEPYKNLKTGKYAKRRAAHTNDVK
QLTEAVQKIAMESIVIWGKTPKFRLPIQKETWETWWTEYWQATWIPEWEFVNTPPLVKLW
YQLEKEPIAGAETFYVDGAANRETKMGKAGYITDRGRQKIISLTETTNQKTELHAIQLAL
QDSGSEANIVTDSQYALGIIQAPDRSESELVNQIIEQLIKKERVYLAWVPAHKGIGENE
QVDKLVSSGIRKILFLDGIDKAQEEHEKYHSNWKAMASEFNLPPVVAREIVASCDKCQLK
GEAMHGQVDCSPRIWQLDCTHLERKVILVAVHVASGYMEAEVIPAETGQETAYFILKLAG
RWPVKVIHTDNGSNFTSNAVKAACWWAGIHQEFGIPYNPQSQGVVESMNKELKKIIEQVR
DQAEHLKTAVQMAVLIHNFKRKGGIGGYTAGERIIDIIATDIQTKELQNQITKIQNFRVY
YRDNRDPIWKGPAKLLWKGEGAVVLQDNSDIKVVPRRKVKIIRDYGKQMAGADCVAGRQD
ED-
>POL-C.syn6.4
FFRKNLAFPQGEAREFPPEQTRANSPTSR--------------ELQV--RGDNPLSEAGA
ERQGTLQGT---LNCPQITLWQRPLVSIKVGGQIKEALLDTGADDTVLEEISLPGKWKPK
MIGGIGGFIKVRQYDQIVIEICGKKAIGAVLVGPTPVNIIRRNMLTQLRCTLNFPISPIK
TVPVKLKPGMDGPKVQWPLSEEKIKALTAICEDMEKEGKITKIGPENPYNTPIFAIKKK
DSTKWRKLVDFRELNKRTQDFWEVQLGIPHPSGLKKKKSVTVLDVEDAYFSVPLDEGFRK
YTAFTIPSINNATPGIRYQYNVLPQGWKGSPAIFQSSMTKILEPFRTKNPDTVTYQYMDD
LYVGSDLEIGQHRAKIEKLREHLLRWGLTTPDKKHQKEPPFLWMGYELHPDKWTVQPIQL
PDKDSWTVNDIQKLVGKLNWASQIYAGIKVKQLCRLLRGAKALTDIIPLTEEAELELAEN
REILKEPVHGAYYDPSKDLIAEIQKQGQGQWTYQIYQEPYKNLKTGKYAKMRTAHTNDVK
QLAEAVQKITMESIVIWGRTPKFRLPIQKETWETWWTDYWQATWIPEWEFINTPPLVKLW
YQLEKEPIVGAETFYVDGAANRETKLGKAGYVTDKGRQKIVSLTETTNQKTELQAIHLAL
QDSGSEVNIVTDSQYALRIIQAPDKSESELVNQIIEQLINKERIYLSWVPAHKGIGGNE
QVDKLVSNGIRKVLFLDGIEKAQEEHERYHSNWRAMANEFNLPPIVAREIVASCDKCQIK
GEAMHGQVDCSPGVWQLDCTHLEGKVILVAVHVASGYVEAEVIPAETGQEAAYFILKLAG
RWPVKTIHTDNGSNFTSTAVKAACWWAGIKQEFGIPYNPQSQGVVESMNKELKKIIGQVR
DQAEHLKTAVQMAVLIHNFKRKGGIGDYSAGERIIDIIATDMQTKELQKQIIKVQNFRVY
YRDSRDPIWKGPAKLLWKGEGAVVIQDNGDIKVVPRRKVKIIKDYGRQMAGADCVASRQD
ED-
```

Fig. 10 cont'd-22

```
>POL-C.syn6.5
FFRENLAFPEGEAREFPSEQARANSPTSR-------------ELQV--RRDNPRSEAGA
EG----QGT---LNFPQITLWQRPLVSIRVGGQIKEALLDTGADDTVLEEINLPGRWKPK
MIGGIGGFIKVRQYDQITIEICGKKAIGTVLVGPTPINIIGRNMLTQIGCTLNFPISPIE
TVPVKLKPGMDGPKIKQWPLTEEKIKALKAICEEMEKEGKIEKIGPENPYNTPVFAIKKK
DSTKWRKLVDFRELNKRTQDFWEIQLGIPHPAGLKRKKSVTVLDVGDAYFSVPLYEDFRK
YTAFTIPSVNNETPGIRYQYNVLPQGWKGSPAIFQCSMTKILEPFRAQNPEIVIYQYMDD
LYVGSDLEIGQHRAKVEELREHLLKWGLTTPDKKHQKEPPFLWMGYELHPDKWTVQPIQL
PEKESWTVNDIQKIVGKLNWASQIYPGIKVRQLCRLLRGAKALTDIVPLTAEAELELAEN
REILKEPVHGVYYDPSKELIAEIQKQGDDQWTYQIYQEPFKNLKTGKYAKMRSAHTNDVK
QLTEAVQKIALESIVIWGKAPKFRLPIQKETWEIWWTDYWQATWIPEWEFINTPPLVKLW
YQLEKEPIAGVETFYVDGAANRDTKIGKAGYVTDRGRQKIVSLSETTNQKTELQAIQLAL
QDSGLEVNIVTDSQYALGIIQAQPDNSESELVNQIIEELIKKERVYLSWVPAHKGIGGNE
QVDKLVSKGIRKVLFLDGIDKAQEEHEKYHNNWRAMASDFNLPPVVAKEIVACCDKCQLK
GEAIHGQVDCSPGIWQLDCTHLEGKVIIVAVHVASGYLEAEVIPAETGQETAYFLKLAG
RWPVKVIHTDNGPNFTSAAVKAACWWAGINQEFGIPYNPQSQGVVESMNKELKKIIGQVR
EQAEHLKTAVQMAVFIHNFKRKGGIGGYSAGERIVDIIATDIQTKELQNQIIKIQNFRVY
YRDSRDPIWKGPAKLLWKGECAVVIQENSDIKVVPRRKAKIIKDYGKQMAGDDCVAGRQD
EDQ
>POL-C.syn6.6
FFRENLAFQQGEAREFPSEQTRANSPT-RANSPTSRTNSPTSRELQV--RGDNPHSEAGA
ER----QGS---LNFPQITLWQRPLVTIKIGGQLKEALLDTGADDTVLEDINLPGKWKPR
MIGGIGGFIKVRQYEQIPIEICGKKAIGTVLIGPTPVNIIGRNLLTQLGCTLNFPISPLE
TIPVKLKPCMDGPKVKQWPLTEEKIKALTAICEEMEKEGKITKIGPDNPYNTPVFAIKKK
DSTKWRKLVDFRELNKRTQDFWEVQLGIPHPAGLKKKKSVTVLDVGDAYFSVPLDKDFRK
YTAFTIPSTNNETPGIRYQYNVLPQGWKGSPAIFQSSMIKILEPFRAKNPELVTYQYMDD
LYVGSDLEIMQHRAKIEELRAHLLKWGFTTPDKKHQKEPPFLWMGYELHPDKWTVQPIVL
PEKDSWTVNDIQKLVGKLNWASQIYPGIKVKQLCKLLRGTKALTDIVPLTEEAELELAEN
REILKETVHGAYYDPSKDLIAEIQKQGYDQWTYQIYQEPFKNLKTGKYAKKRTAHTNDVR
QLTEAVQKIATESIVIWGKTPKFRLPIQKETWETWWADYWQATWIPEWEFVNTPPLVKLW
YQLEKDPIAGAETFYVDGAANRETKKGKAGYVTDKGRQKVVTLTETTNQKAELQAICLAL
QDSGPEVNIVTDSQYALRIIQAQPDKSESGLVNQIIEQLIKKEKVYLSWVPAHKGIGGNE
QTDKLVSSGIRRVLFLDGIDKAQEDHEKYHSNWRAMAGEFNLPPVVAKEIVASCDKCQQK
GEAIHGQVDCSPGIWQLDCTHLEGKIILVAVHVASGYIEAEVIPAETGQDTAYYILKLAG
RWPVKVIHTDNGTNFTSAAVKAACWWASIQQEFGIPYNPQSQGVVEAMNKELKKITGQIR
DQAEHLKTAVLMAVFIHNFKRKGGIGEYSAGERIIDIIASDIQTKELQKQITKIQNFRVY
YRDSRDPVWKGPAKLLWKGEGAVVIQDNSDIKVIPRRKAKIIRDYGKQMAGADCVAGGQD
ED-
>POL-M.syn1.1
FFRENLAFPQGEAREFPSEQTRANSPTSRANSPTSR-------ELQV--RGDNPRSEAGA
ER----QGT---LNFPQITLWQRPLVTIKIGGQLKEALLDTGADDTVLEDINLPGKWKPK
MIGGIGGFIKVRQYDQILIEICGKKAIGTVLVGPTPVNIIGRNMLTQIGCTLNFPISPIE
TVPVKLKPGMDGPKVKQWPLTEEKIKALTEICTEMEKEGKISKIGPENPYNTPVFAIKKK
DSTKWRKLVDFRELNKRTQDFWEVQLGIPHPAGLKKKKSVTVLDVGDAYFSVPLDESFRK
YTAFTIPSINNETPGIRYQYNVLPQGWKGSPAIFQSSMTKILEPFRKQNPDIVIYQYMDD
LYVGSDLEIGQHRAKIEELREHLLKWGFTTPDKKHQKEPPFLWMGYELHPDKWTVQPIQL
PEKDSWTVNDIQKLVGKLNWASQIYPGIKVKQLCKLLRGAKALTDIVPLTEEAELELAEN
REILKEPVHGVYYDPSKDLIAEIQKQGQDQWTYQIYQEPFKNLKTGKYAKMRTAHTNDVK
QLTEAVQKTATESIVIWGKTPKFRLPIQKETWETWWTDYWQATWIPEWEFVNTPPLVKLW
YQLEKEPIVGAETFYVDGAANRETKLGKAGYVTDRGRQKVVSLTETTNQKTELQAIQLAL
QDSGSEVNIVTDSQYALGIIQAQPDKSESELVNQIIEQLIKKEKVYLSWVPAHKGIGGNE
QVDKLVSSGIRKVLFLDGIDKAQEEHEKYHSNWRAMASDFNLPPIVAKEIVASCDKCQLK
GEAMHGQVDCSPGIWQLDCTHLEGKVILVAVHVASGYIEAEVIPAETGQETAYFILKLAG
RWPVKVIHTDNGSNFTSAAVKAACWWAGIQQEFGIPYNPQSQGVVESMNKELKKIGQVR
DQAEHLKTAVQMAVFIHNFKRKGGIGGYSAGERIIDIIATDIQTKELQKQITKIQNFRVY
```

Fig. 10 cont'd-23

```
YRDSRDPIWKGPAKLLWKGEGAVVIQDNSDIKVVPRRKAKIIRDYGKQMAGDDCVAGRQD
EDQ

>POL-M.syn3.1
FFRENLAFPQGEAREFPSEQTRANSPTSRANSPTSR-------ELQV--RGDNPRSEAGA
ER----QGT---LNFPQITLWQRPLVSIKVGGQIKEALLDTGADDTVLEEINLPGKWKPK
MIGGIGGFIKVRQYDQIPIEICGKRAIGTVLGPTPINIIGRNMLTQLGCTLNFPISPIK
TVPVKLKPGMDGPKVKQWPLTEEKIKALTAICEEMEKEGKITKIGPENPYNTPVFAIKKK
DGTKWRKLVDFRELNKRTQDFWEVQLGIPHPSGLKKKKSVSVLDVGDAYFSVPLDESFRK
YTAFTIPSINNETPGIRYCYNVLPQGWKGSPAIFQCSMTKILEPFRAQNPEIVIYQYMDD
LYIGSDLEIGQHRAKIEELREHLLRWGFTTPDKKHQKEPPFLWMGCELHPDKWTVQPIQL
PEKDSWTVNDIQKIVGKLNWASQIYPGIKVRQLCKLLRGAKALTDIVPLTEEAELELAEN
REILREPVHGVYYDPSKDLVAEIQKQGQDQWTYQIYQEPFKNLKTGKYAKMRTAHTNDVK
QLTEAVQKIALESIVIWGKIPKFRLPIQKETWEAWWMEYWQATWIPEWEFINTPPLVKLW
YQLEKEPIAGAETFYVDGAANRETKIGKAGYVTDRGRQKIVSLTETTNQKAELQAIQLAL
QDSGPEVNIVTDSQYALGIIQAHPDKSESELVNQIIEQLIKKERVYLSWVPAHKGIGENE
QVDKLVSNGIRKILFLDGIDKAQEEHEKYHSNWRAMASEFNLPPIVAKEIVASCNKCQLK
GEALHGQVDCSPGMWQLDCTHLEGKVILVAVHVASGYMEAEVIPAETGQETAYYILKLAG
RWPVKVVHTDNGSNFTSTAVKAACWWAGIQQEFGIPYNPQSQGVTESMNKELKKIIGQIR
DQAEHLKTAVQMAVFIHNFKRKGGIGEYSAGERIIDIIATDIQTRELQKQIIKIQNFRVY
YRDSRDPIWKGPAKLLWKGEGAVVLQDNSDIKVVPRRKVKIIKDYGKQMAGADCVAGRQD
ENQ >POL-M.syn3.2
FFRENLAFQQGEARKFSSEQTGANSPTSR--------------ELRV-RRGDNPLSEAGA
ER----RCTVPSLSFPQITLWQRPLVTVKIGGQLIEALLDTGADDTVLEDINLPGKWKPR
MIGGIGGFIKVKQYDQILIEICGKKAIGTVLGPTPVNIIGRNMLTQIGCTLNFPTSPID
TVPVTLKPGMDGPKIKQWPLTEEKIKALTEICTEMEKEGKISRIGPENPYNTPIFAIKKK
DSTKWRKLVDFRELNKKTQDFWEVQLGIPHPAGLKKKRSVTVLDVGDAYFSVPLDKDFRK
YTAFTIPSTKNETPGIRYQYNVLPQGWKGSPSIFQSSMTRILEPFRAKNPEIVIYQYMDD
LYVGSDLEIEQHRTKIEELRQHLLRWGLTTPDKKHQKEPPFLWMGYELHPDRWTVQPIEL
PEKESWTVNDIQKLVGKLNWASQIYAGIKVKQLCKLLRGTKALTEVVPLTEEAELELEEN
RETLKDPVHGAYYDPSKDLIAEIQKQGHDQWTYQIYQEQYKNLKTGKYARKRSAHTNDVR
QLTEAVQKIATESIVIWGKTPKFRLPIQRETWETWWTDYWQATWIPEWEFVNTPPLVKLW
YQLEKDPIAGVETFYVDGASNRETKKGKAGYVTDKGRQKVVSLTETTNQKTELHAIHLAL
QDSGSEVNIVTDSQYALGIIQAQPDRSESELVNQIIEELIKKEKVYLSWVPAHKGIGGNE
QVDKLVSSGIRKVLFLDRIDKAQEEHERYHSNWRTMASDFNLPPIVAKEIVANCDKCQLK
GEAMHGQVDCSPGIWQIDCTHLEGKVIIVAVHVASGYIEAEVIPAETGQETAYFLLKLAG
RWPVKVTHTDNGSNFTSAAVKAACWWANVTQEFGIPYNPQSQGVESMNKELKKIIGQVR
EQAEHLKTAVQMAVLIHNFKRKGGIGGYSAGERIIDIIASDIQTKELQKQIIKVQNFRVY
YRDSRDPVWKGPAKLLWKGEGAVVIQDNSDIKVVPRRKVKIIRDYGKQMAGDDCVAGRQD
EDQ >POL-M.syn3.3
FFREDLAFPQGKAREFSSEQTRANSPTRR--------------ELQVWGRDNNSLSEAGA
DR----QGTVS-FSFPQITLWQRPLVTIKIGGQLKEALLDTGADDTVLEEMNLPGRWKPK
MIGGIGGFIKVRQYDQILIEICGHKAIGTVLIGPTPVNIIGRNLLTQIGCTLNFPISPIE
TVPVKLKPGMDGPRVKQWPLTEEKIKALVEICTEMEKEGKISKIGPENPYNTPVFAIKKK
DSTRWRKLVDFRELNKRTQDFWEIQLGIPHPAGLKKKKSVTVLDVGDAYFSVPLDEGFRK
YTAFTIPSVNNETPGVRYQYNVLPQGWKGSPAIFQSSMTKILEPFRKQNPDIVIYQYMDD
LYVGSDLEIGQHRTKIEELREHLLKWGFTTPDKKHQNEPPFLWMGYELHPDKWTVQPIVL
PEKDSWTVNDLQKLVGKLNWASQIYPGIKVQQLCRLLRGAKALTEVIPLTKEAELELAEN
REILKEPVHGVYYDPSKELIAEIQKQGQGQWTYQIYQEPYKNLKTGKYARMRCAHTNDVK
QLTEVVQKIAMESIVIWGKTPKFKLPIQKETWETWWTEYWQATWIPDWEFVNTPPLVKLW
YQLEKEPIVGAETFYVDGAANRETKLGKAGYVTDRGRQKVVSLTDTTNQKTELQAIHLAL
QDSGLEVNIVTDSQYAIGIIQAQPDKSESELVSQIIEQLIKKEKVYLAWVPAHKGIGGNE
QVDKLVSAGIRKVLFLDGIDKAQEDHEKYHNNWRAMASDFNLPPVVAKEIVASCDKCQLK
```

Fig. 10 cont'd-24

```
GEAIHGQVDCSPGIWQLDCTHLEGKIILVAVHVASGYLEAEVIPAETGQETAYFILKLAG
RWPVKTIHTDNGSNFTSTTVKAACWWAGIKQEFGIPYNPQSQGVVESINKELKKIIGQVR
DQAEHLKTAVLMAVFIHNFKRRGGIGGYSAGERIVDIIATDIQTKELQKQITKIQNFRVY
YRDSRDPLWKGPAKLLWKGEGAVVIQDNSEIKVVPRRKAKIIRDYGKQMAGDDCVASRQD
ED-
>POL-M.syn4.1
FFRENLAFQQGEARKFSSEQTRANSPTRG--------------ELQVWGRDNNPLSEAGA
ER----RGTVPSLSFPQITLWQRPLVTVKTGGQLIEALLDTGADDTVLEDINLPGKWKPK
MIGGIGGFIKVKQYDQILIEICGKKAIGTVLVGPTPVNIIGRNMLTQIGCTLNFPISPID
TVPVTLKPGMDGPRIKQWPLTEEKIKALTEICKEMEEEGKISKIGPENPYNTPIFAIKKK
NSTRWRKLVDFRELNKKTQDFWEVQLGIPHPAGLKRKKSVTVLDVEDAYFSVPLDESFRK
YTAFTIPSINNETPGVRYQYNVLPQGWKGSPAIFQCSMTKILEPFRIKNPEMVIYQYMDD
LYVGSDLEIGQHRIKIEELRAHLLSWGFTTPDKKHQKDPPFLWMGYELHPDRWTVQPIEL
PEKDSWTVNDIQKLVEKLNWASQIYSGIKVRQLCRLLRGAKALTDIVPLTEEAELELAFN
REILKEPVHGAYYDPSKDLVAEIQKQGQDQWTYQIYQEPFKNLTGKYARKRSAHTNDVK
QLTEVVQKIATESIVIWGKTPKFRLPIQRETWETWWTEYWQATWIPEWEFVNTPPLVKLW
YQLEKDPIAGVETFYVDGAASRETKLGKAGYVTDRGRQKVVSLTETTNQKTELHAIHLAL
QDSGSEVNIVTDSQYVLGIIQAQPDRSESELVNQIIERLIKKEKVYLSWVPAHKGIGGNE
QVDKLVSSGIRKVLFLNGTDKAQEEHERYHSNWRTMASDFNLPPIVAKEIVANCDKCQLK
GEAMHGQVDCSPGVWQLDCTHLEGKVIIVAVHVASGYIEAEVIPAETGCEAAYFILKLAG
RWPVKVVHTDNGSNFTSAAVKAACWWANVRQEFGIPYNPQSQGVVESMNNELKKIIGQIR
DQAFHLKTAVLMAVFIHNFKRKGGTGEYSAGERIIDIIATDIQTRELQKQITKIQNFRVY
FRDSRDPIWKGPAKLLWKGEGAVVIQDNSEIKVVPRRKVKIIRDYGKQMAGDDCVAGRQD
EN-
>POL-M.syn4.2
FFRENLAFPQGEAREFPSEQARANSPTSRANSPTSR-------DLWDGGRDNLP-SEAGA
ER----QGT---LNFPQITLWQRPLVTVRIGGQLREALLDTGADDTVLEDIDLPGKWKPK
IIGGIGGFIKVRQYEQIPIEICGHKAIGTVLVGPTPINIIGRNMLTQLGCTLNFPISPIK
TVPVKLKPGMDGPRVKQWPLTEEKIKALTAICEEMEKEGKITKIGPENPYNTPVFAIKKK
DSTRWRKLVDFRELNRRTQDFWEVQLGIPHPAGLKKKRSVTVLDVGDAYFSVPLDEGFRK
YTAFTIPSVNNETPGIRYQYNVLPQGWKGSPSIFQSSMTRILEPFRAKNPEIVIYQYIDD
LYVRSDLETGQHRAKIEELREHLLRWGFTTPDKKHQKEPPFLWMGCELHPDKWTVQPIQL
PEKDSWTINDIQKLVGKLNWASQIYPGIKVRQLCKLLRGTKALTDIVTLTEEAELELAEN
REILKDPVHGVYYDPSKELIAEIQKQGDDQWTYQIYQEYKNLTGKYAKRRTAHTNDVR
QLTEAVQKIALESIVIWGKIPKFRLPIQKETWEAWWMEYWQATWIPEWEYVNTPPLVKLW
YQLEKEPIIGAETFYVDGAANRETKLGKAGYVTNRGRQKVVSLTDTTNQKTELQAIQLAL
QDSGSEVNVVTDSQYALGIIQAHPDKSESELVNQIIEQLIKKERVYLSWVPAHKGIGGNE
QVDKLVSAGIRKVLFLDGIDKAQEDHERYHSNWRAMASDFNLPPVVAKEIVASCNKCQLK
GEAIHGQVDCSPGIWQLDCTHLEGKIIIVAVHVASGYMEAEVIPAETGQETAYFILKLAG
RWPVKIIHTDNGSNFTSATVKAACWWANVTQEFGIPYNPQSQGVVESINKELKKIIGQVR
DQAEHLRTAVQMAVFIHNFKRRGGIGGYSAGERIVDIIATDIQTKEIQKQITKIQKFRVY
YRDSRDPLWKGPAKLLWKGEGAVVIQDNSDIKVIPRRKAKIIKDYGKQMAGADCVAGRQD
EDQ
>POL-M.syn4.3
FFRENLAFPQGKAREFPSEQTRANSPTSRANSPTSR-------ELQV--RGDNPRSEAGA
ER----QGT---FNFPQTTLWQRPLVSIKVGGQIKEALLDTGADDTVLEEINLPGKWKPR
MIGGIGGFIKVRQYDQILIEICGKRAIGTVLVGPTPANIIGRNLLTQLGCTLNFPISPIE
TVPVKLKPGMDGPKIKQWPLTEEKIKALTEICTEMEKEGKISKIGPENPYNTPIFAIKKK
DSTKWRKLVDFKELNKRTQDFWEVQLGIPHPSGLKKKKSVTVLDVGDAYFSVPLDEDFRK
YTAFTIPSTNNETPGIRYQYNVLPQGWKGSPAIFQASMTKILEPFRAQNPEIVIYQYMDD
LYVGSDLEIEQHRAKVEELREHLLWGFTTPDKKHQNEPPFLWMGYELHPDKWTVQPIKL
PEKESWTVNDIQKLVGKLNWASQIYPGIKVKQLCRLLRGTKALTEVIPLTKEAELELAEN
REILREPVHGVYYDPTKDLIAEIQKQGHDQWTYQIYQEPHKNLTGKYAKMRTAHTNDVK
QLAEAVQKIAMESIVIWGKIPKFKLPIQKETWETWWTDYWQATWIPDWEFVNTPPLVKLW
```

Fig. 10 cont'd-25

```
YQLEKEPIAGAETFYVDGAANRETKIGKAGYVTDRGRQKIVSLTETTNQKAELQAIQLAL
QDSGPEVNIVTDSQYALGIIQAQPDKSESEIVNQIIEKLIEKDKVYLSWVPAHKGIGGNE
QIDKLVSNGIRKVLFLDGIEKAQEEHEKYHSNWRAMASEFNLPPIVAKEIVASCDKCQLK
GEATHGQVDCSPGMWQLDCTHLEGKIILVAVHVASGYIEAEVIPTETGQETAYYILKLAG
RWPVKVIHTDNGSNFTSTAVKAACWWAGIQQEFGIPYNPQSQGVVESMNKELKKIIGQVR
EQAEHLKTAVQMAVLIHNFKRKGGIGGYSAGERIIDIIASDIQTKELQKQIIKVQNFRVY
YRDSRDPIWKGPAKLLWKGEGAVVLQDNSDIKVVPRRKVKIIKDYGKQMAGADCVASRQD
EN-
>POL-M.syn4.4
FFREDLAFPQGKAREFSSEQTRANSPTRR--------------ELQVWGRDNNSLSEAGA
DR----QGTVS-FSFPQITLWQRPLVTIKIGGQLKEALIDTGADDTVLEEMNLPGRWKPK
MIGGIGGFIKVRQYDQIPIEICGKKAIGTVLIGPTPVNIIGRNLLTQIGCTLNFPISPIE
TIPVKLKPGMDGPKVKQWPLTEEKIKALVEICTEMEKEGKISRIGPENPYNTPVFAIKKK
DGTKWRKLVDFRELNKRTQDFWEIQLGIPHPAGLKKKKSVSVLDVGDAYFSVPLDKDFRK
YTAFTIPSINNETPGIRYCYNVLPQGWKGSPAIFQSSMTKILEPFRKQNPDIVIYQYMDD
LYIGSDLEIGQHRTKIEELRQHLLRWGLTTPDKKHQNEPPFLWMGYELHPDKWTVQPIVL
PEKDSWTVNDLQKLVGKLNWASQIYAGIKVKQLCKLLRGAKALTEVVPLTEEAELELEEN
REILKEPVHGVYYDPSKDLIAEIQKQGQGQWTYQIYQEPYKNLKTGKYARMRGAHTNDVK
QLTEAVQKIAQECIVIWGKTPKFKLPIQKETWETWWMDYWQATWIPEWEFINTPPLVKLW
YQLEKEPIVGAETFYVDGASNRETKKGKAGYVTDKGRQKVVTLTETTNQKTELQATHLAL
QDSGLEVNIVTDSQYAIGIIQAQPDKSESELVSQIIEQLIKKEKVYLAWVPAHKGIGGNE
QVDKLVSNGIRKILFLDGIDKAQEEHEKYHNNWRAMASDFNIPPVVAKEIVACCDKCQLK
GEALHGQVDCSPRIWQLDCTHLEGKVILVAVHVASGYLEAEVIPAETGQETAYFLLKLAG
RWPVKTIHTDNGSNFTSTTVKAACWWAGIKQEFGIPYNPQSQGVIESMNKELKKIIEQVR
DQAEHLKTAVQMAVFVHNFKRKGGIGDYSAGERIIDIISTDIQTRELQKQTIKIQNFRVY
YRDSRDPVWKGPAKLLWKGEGAVVIQDNNEIKVVPRRKAKIIRDYGKQMAGDDCVASRQD
ED- >POL-M.syn6.1
FFREDLAFPQGEARKFPSEQTRANSPTRG--------------ELQVWGRDNNSLSEAGD
DR----QGTVS-FNLPQITLWQRPLVTVRIGGQLIEALLDTGADDTVLEDMNLPGKWKPK
MIGGIGGFIKVRQYEQIPIEICGHKAIGTVLIGPTPVNIIGRNLLTQIGCTLNFPTSPID
TVPVTLKPGMDGPKIKQWPLTEEKIKALTEICTEMEKEGKISRIGPENPYNTPVFAIKKK
NSTRWRKLVDFRELNKRTQDFCEVQLGIPHPAGLKKKRSVTVLDVGDAYFSVPLDENFRK
YTAFTIPSINNETPGVRYCYNVLPQGWKGSPAIFQASMTKILEPFRTKNPELVIYQYMDD
LYVGSDLEIEQHRTKIEELRAHLLSWGFTTPDKKHQKEPPFLWMGYELHPDKWTVQPIEL
PEKDSWTVNDIQKIVGKLNWASQIYPGIKVRQLCRLLRGTKALTDIVPLTAEAELELAEN
REILREPVHGVYYDPSKELIAEIQKQGHDQWTYQIYQDPFKNLKTGKYARKRSAHTNDVR
QLTEAVQKITTESIVIWGKTPKFRLPIQRETWEAWWMEYWQATWIPEWEFINTPPLVKLW
YQLEKDPIVGAETFYVDGAASRETKLGKAGYVTNKGRQKVVSLNETTNQKTELHAIHLAL
QDSGSEANIVTDSQYALGIIQAQPDRSESEVVNQIIEELIKKEKVYLSWVPAHKGIGGNE
QVDKLVSSGIRKVLFLDGIDKAQEDHERYHSNWRTMASDFNLPPIVAREIVASCDKCQQK
GEAMHGQVDCGPGIWQLDCTHLERKVILVAVHVASGYIEAEVIPAETGQETAYFVLKLAG
RWPVKVIHTDNGSNFTSAAVKAACWWANVTQEFGIPYNPQSQGVVESMNNELKKIIGQVR
EQAEHLKTAVLMAVFIHNFKRKRGIGGYSAGERIVDIIASDIQTKELQNQITKIQNFRVY
FRDSRDPIWKGPAKLLWKGEGAVVIQDNNDIKVVPRRKVKIIRDYGKQMAGDDCVAGRQD
EN-
>POL-M.syn6.2
FFREDLAFQQGEARKFSSEQTRANSPTSR--------------ELRVWG-GDNTLSETGA
ER----QGT---LNFPQITLWQRPLVTIKVGGQIKEALLDTGADDTVLEDINLPGKWKPR
MIGGIGGFIKVRQYDQIPIEICGKKAIGSVLVGPTPVNIIGRNMLTQLGCTLNFPISPIK
TVPVKLKPGMDGPKVKQWPLSEEKIKALTAICDEMEKEGKITKIGPDNPYNTPVFAIKKK
DGTKWRKLVDFKELNKRTQDFWEIQLGIPHPAGLKKKKSVSVLDVGDAYFSVPLDESFRK
YTAFTIPSLNNETPGIRYCYNVLPQGWKGSPAIFQSSMTKILEPFRAQNPEIVIYQYIDD
LYVRSDLEIGQHRAKIEELREHLLKWGLTTPDKKHQKEPPFLWMGYELHPDRWTVQPIQL
```

Fig. 10 cont'd-26

```
PDKDSWTVNDLQKLVGKLNWASQIYPGIRVKQLCKLLKGAKALTDIVTLTEEAELELAEN
REILKNPVHGVYYDPAKDLIAEIQKQGNDQWTYQIYQEPHKNLKTGKYAKMRTAHTNDVK
QLTEVVQKIAMESIVIWGKVPKFRLPIQKETWETWWTDYWQATWIPDWEFVNTPPLVKLW
YQLEKEPIAGAETFYVDGAANRETKMGKAGYVTDRGRQKVVSLTETTNQKTELQAIQLAL
QDSGPEVNIVTDSQYAIGIIQAPDKSESEIVNQIIEQLIKKERVYLSWVPAHKGIGENE
QVDKLVSTGIRRVLFLDGIDKAQEEHERYHSNWRAMASEFNLPPIVAKEIVASCDQCQLK
GEAMHGQVDCSPGVWQLDCTHLEGKIILVAVHVASGYMEAEVIPAETGQETAYFILKLAA
RWPVKVIHTDNGPNFTSATVKAACWWANITQEFGIPYNPQGQGVVESMNKELKKIIKQVR
DQAEHLKTAVQMAVLIHNFKRKGGIGGYSAGERIIDIIASDIQTKELQKQIIKIQNFQVY
YRDSRDPIWKGPAKLLWKGEGAVVLQDNSDIKVVPRRKVKIIKDYGKQMAGADCVAGGQD
ED-
>POL-M.syn6.3
FFRENLAFPQGKAREFPSEQTRAISPTSR--------------ELQVWGGDNNSLSEAGA
ER----QGTVS-FSFPQITLWQRPIVTIKIGGQLREALLDTGADDTVLEEMNLPGRWKPK
MIGGIGGFIKVKQYDNILIEICGHKAVGTVLGPTPANIIGRNLLTQLGCTLNFPISPIE
TVPVKLKPGIDGPKVKQWPLTEEKIKALVEICTEMEKEGKISKIGPENPYNTPIFAIKKK
DSTRWRKLVDFRELNRRTQDFWEVQLGIPHPAGLKRKKSVTVLDVGDAYFSVPLDKEFRK
YTAFTIPSINNETPGIRYQYNVLPQGWKGSPSIFQSSMTKILEPFRIKNPEMVIYQYMDD
LYIGSDLEIGQHRIKIEELREHLLKWGFTTPDKKHQKEPPFLWMGCELHPDKWTVQPIML
PEKDSWTVNDIQKLVGKLNWASQIYAGIKVRQLCKLLRGTKALTEVVPLTEEAELELAEN
REILKEPVHGAYYDPSKDLIALVQKQGQDWTYQIYQEPFKNLKTGKYAKKRSAHTNDVK
QLTEAVQKIALESIVIWGKAPKFRLPIQKETWEAWWTEYWQATWVPEWEFVNTPPLVKLW
YQLETEPIAGAETYYVDGAANRETKLGKAGYVTNRGRQKVVSLTDTTNQKTELQAIHLAL
QDSGLEVNIVTDSQYALGIIHAQPDKSESELVNQIIEQLINKERIYLSWVPAHKGIGENE
QVDKLVSKGIRKVLFLDGIEKAQEEHEKYHSNWKAMASEFNLPPVVAKEIVACCDCQLK
GEALHGQVDCSPGMWQLDCTHLEGKIIIVAVHVASGYIEAEVIPTETGQETAYFLLKLAG
RWPVKTIHTDNGSNFTSTTVKAACWWAGIKQEFGIPYNPQSQGVVESINKELKKIIGQIR
DQAEHLKTAVLMAVFIHNFKRKGGIGGYTAGERIVDIIATDIQTKELQKQITKVQNFRVY
YRDSREPLWKGPAKLLWKGEGAVVIQDNNEIKVVPRRKAKILRDYGKQMAGADCVASRQD
EN-
>POL-M.syn6.4
FFRENLAFQQGEAREFSSEQTRTNSPTSR--------------ELWDGGRDNLP-SEAGA
ER----RGTVPSLSFPQTTLWQRPLVTVKIGGQLKEALLDTGADDTVLEEINLPGKWKPK
LIGGIGGFIKVRQYDQILIEICGKKAIGTVLGPTPINIIGRNMLTQIGCTLNFPISPIE
TIPVKLKPGMDGPRVKQWPLTEEKIKALIEICTEMEKEGKISRVGPENPYNTPIFAIKKK
NSNRWRKLVDFRELNKRTQDFWEVQLGIPHPGGLKKKKSVTILDVGDAYFSVPLDEDFRK
YTAFTIPSINNATPGIRYQYNVLPQGWKGSPAIFQCSMTKILEPFRKQNPEIIIYQYMDD
LYVRSDLEIQHRTKIEELRQHLLKWGFYTPDKKHQKEPPFLWMGYELHPDKWTVQPIKL
PEKESWTVNDIQKLVEKLNWASQIYPGIKVKQLCRLLRGAKALTEVIPLTEEAELELEEN
REILKDPVHGVYYDPTKDLIAEIQKQGDDWTYQIYQEPYKNLKTGKYAKRRTAHTNDVR
QLTEVVQKVATESIVIWGKIPKFKLPIQKETWEIWWTDYWQATWIPEWEFVNTPHLVKLW
YQLEKEPIIGAETFYVDGASNRETKKCKAGYVTDRGRQKIVSLTETTNQKAELQAIQLAL
QDSGSEVNIVTDSQYALGIIQAHPDKSESELVSQIIEQLIKKEKVYLAWVPAHKGIGGNE
QIDKLVSNGIRKILFLDGIDKAQEEHEKYHNNWRAMASDFNLPPVVAKEIVASCNKCQLK
GEAIHGQVDCSPRIWQLDCTHLEGKVIMVAVHVASGYVEAEVIPAETGQDTAYFILKLAG
RWPVKVVHTDNGSNFTSAAFKAACWWANVQQEFGIPYNPQSQGVVEAMNKELKKIIEQVR
DQAEHLKTAVQMAVFVHNFKRKGGIGDYSAGERIIDIIATDTQTRELQKQIIKIQNFRVY
YRDNRDPIWKGPAKLLWKGEGAVVIQDNSDIKVIPRRKAKIIRDYGKQMAGDDCMAGRQD
EDQ
>POL-M.syn6.5
FFREDLAFLQGKAREFSSEQTRANSPTRR--------------ELQVWGRDSNSLSEAGA
DR----QGTVS-FNFPQITLWQRPLVTIKIGGQLKEALLDTGADDTVLEDIDLPGKWKPK
IIGGIGGFIKVKQYDQILIEICGKRAIGTVLGPTPVNIIGRNILTQIGCTLNFPISPID
TVPVKLKPGMDGPRIKQWPLTEEKIKALTEICKEMEEEGKISKIGPENPYNTPVFAIKKK
```

Fig. 10 cont'd-27

```
DSTKWRKVVDFRELNKGTQDFWEVQLGIPHPAGLKQKKSVTVLDVEDAYFSVPLDKDFRK
YTAFTIPSVNNETPGIRYQYNVLPQGWKGSPAIFQSSMTRILEPFRKQNPDIVIYQYMDD
LYVGSDLEIGQHRTKVEELRQHLLRWGFTTPDKKHQKDPPFLWMGYELHPDKWTVQPIVL
PEKDSWTINDIQKLVGKLNWASQIYSGIKVRQLCKCLRGTKALTEVIPLTKEAELELAEN
KEILKEPVHGVYYDPSKDLVAEIQKQGQGQWTYQIYQEQYKNLKTGKYARMRGAHTNDVK
QLAEAVQKIATESIVIWGKIPKFRLPIQRETWETWWTEYWQATWIPEWEYVNTPPLVKLW
YQLEKEPIVGAETFYVDGAANRDTKLGKAGYVTDRGRQKVVPLTDTTNQKTELQAINLAL
QDSGSKVNIVTDSQYVLGIIQAQPDRSESEIVNQIIEKLIEKDVYLSWVPAHKGIGGNE
QVDKLVSAGIRKVLFLDGIDKAQDEHEKYHSNWRAMASDFNLPPVIAKEIVASCDKCQLK
GEATHGQVDCSPGIWQLDCTHLEGKVIIVAVHVASGYIEAEVISAETGQETAYYILKLAG
RWPVKIIHTDNGSNFTSTAVKAACWWAGIQQEFGIPYSPQSQGVVESMNKQLKQIIGQVR
DQAEQLKTAVQMAVFIHNFKRKGGIGEYSAGERIIDIISTDIQTRELQKQITKIQNFRVY
YRDSRDPVWKGPAKLLWKGEGAVVIQDNSEIKVVPRRKAKIIRHYGKQMAGDDCVASRQD
EDQ
>POL-M.syn6.6
FFRENLAFPQGEAREFPSEQARANSPTSRANSPTSR------ELQV--RGDNPRSEAGA
ERQGTLQGT---LNCPQITLWQRPLVSIKVGGQVKEALLDTGADDTVLEEMSLPGKWKPK
MVGGIGGFIKVRQYDQILVEICGHKAIGTVLVGPTPVNIIRRNMLTQLRCTLNFPISPIE
TVPVTLKPGMDGPKVRQWPLTEEKIKALTAICEEMEKEGKITKIGPENPYNTPVFAIRKK
DSTKWRKLVDFRELNKKTQDFWEVQLGIPHPSGLKKKKSVTVLDVGDAYFSVPLDEGFRK
YTAFTIPSTNNETPGIRYQYNVLPQGWKGSPAIFQSSMIKILEPFRAKNPEIVIYQYMDD
LYVGSDLEIGQHRAKVEELREHLLRWGFTTPDKKHQNEPPFLWMGYELHPDKWTVQPIQL
PEKDSWTVNDIQRLVGKLNWASQIYAGIKVKQLCKLLRGAKALTDIVPLTEEAELELAEN
REILKTPVHGVYYDPSKDLIAEIQKQGQDWSYQIYQEPFKNLKTGKYARTRGAHTNDVR
QLTEAVQKIAQECIVIWGKTPKFKLPIQKDTWETWWMDYWQATWIPKWEFVNTPPLVKLW
YQLEKDPIAGVETFYVDGAANRETKIGKAGYVTDKGRQKVVTLTETTNQKTELHAIYLAL
QDSGSEVNVVTDSQYALGIIQAQPDRSESELVNQIIEKLIGKDVYLSWVPAHKGIGENE
QVDKLVSNGIRKVLFLDGIDKAQEDHEKYHSNWRAMANEFNLPPIVAKEIVANCDKCQLK
GEAMHGQVDCSPGIWQIDCTHLEGKVILVAVHVASGYLEAEVIPAETGQEAAYFILKLAG
RWPVKTVHTDNGSNFTSNAVKAACWWANVRQEFGIPYNPQSQGVIESMNKELKKIIGQVR
DQAEHLRTAVQMAVFIHNFKRRGGIGGYSAGERMIDIIATDIQTTELQKQITKIQKFRVY
YRDSRDPLWKGPAKLLWKGEGAVVIQENSDIKVVPRRKAKIIKDYGKQVAGADCVAGRQD
EDQ
```

Fig. 11

This plot is alignment independent, based on splintering all M group proteins, (database and CHAVI, one sequence per person) into all possible 9-mers, attending to their frequencies, and then looking for matches and near matches in each vaccine antigen or cocktail with the database

| Vaccine | subset | Off-by0 | Off-by1 | Off-by2 | (<3,>1) | unique | absent | rare < 3 |
|---|---|---|---|---|---|---|---|---|
| ConSgp160 | Total | 0.2628 | 0.5301 | 0.7267 | 9 | 12 | 45 | 66 |
| ConSgp160 | B | 0.2682 | 0.5344 | 0.7223 | 2 | 8 | 45 | |
| ConSgp160 | C | 0.2526 | 0.5214 | 0.7302 | 1 | 0 | 45 | |
| ConSgp160 | N | 0.2662 | 0.5332 | 0.7283 | 7 | 4 | 45 | |
| Mos.3 | Total | 0.4485 | 0.7032 | 0.8358 | 15 | 164 | 8 | 179 |
| Mos.3 | B | 0.4749 | 0.7319 | 0.8576 | 3 | 40 | 8 | |
| Mos.3 | C | 0.4809 | 0.7363 | 0.8498 | 8 | 65 | 8 | |
| Mos.3 | N | 0.3868 | 0.6383 | 0.7970 | 11 | 59 | 8 | |
| Nat.1.acute | Total | 0.2258 | 0.4598 | 0.6458 | 125 | 0 | 0 | 125 |
| Nat.1.acute | B | 0.3190 | 0.5803 | 0.7482 | 125 | 0 | 0 | |
| Nat.1.acute | C | 0.1589 | 0.3781 | 0.5726 | 0 | 0 | 0 | |
| Nat.1.acute | N | 0.1815 | 0.3979 | 0.5968 | 0 | 0 | 0 | |
| Nat.3.acute | Total | 0.3673 | 0.6449 | 0.8036 | 164 | 252 | 0 | 416 |
| Nat.3.acute | B | 0.3765 | 0.6483 | 0.8045 | 130 | 0 | 0 | |
| Nat.3.acute | C | 0.3940 | 0.6840 | 0.8307 | 19 | 102 | 0 | |
| Nat.3.acute | N | 0.3311 | 0.6036 | 0.7766 | 21 | 150 | 0 | |

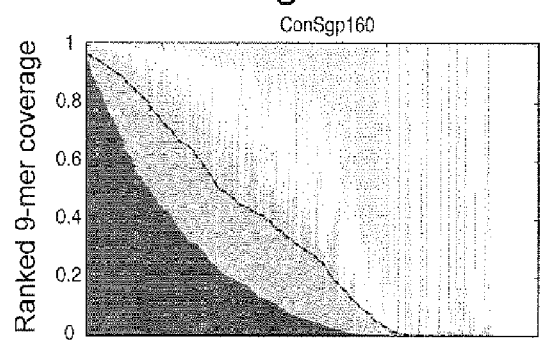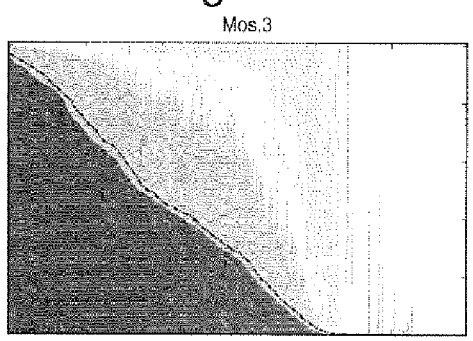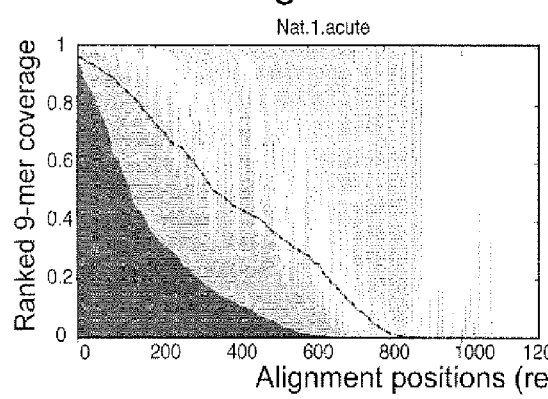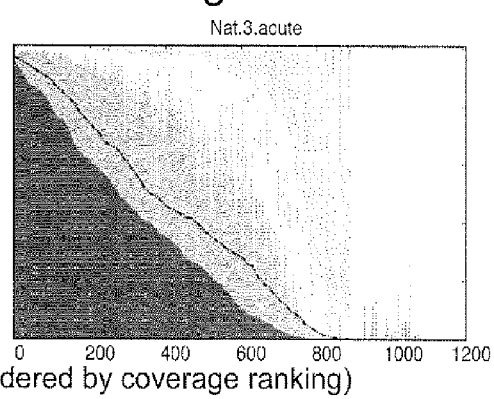
Fig. 14A ConSgp160
Fig. 14B Nat.1.acute
Fig. 14C Mos.3
Fig. 14D Nat.3.acute
up to 7/9 match
up to 8/9 match
exact match
total 9-mers
Upper bound: 3 antigens Con S Mos.3

Nat.1

Nat.3

Env alignment position     0 1 2 3 4 5 6 7 8 9

B clade

Fig. 17

Coverage of the HIV database plus CHAVI sequences (N = 2020)

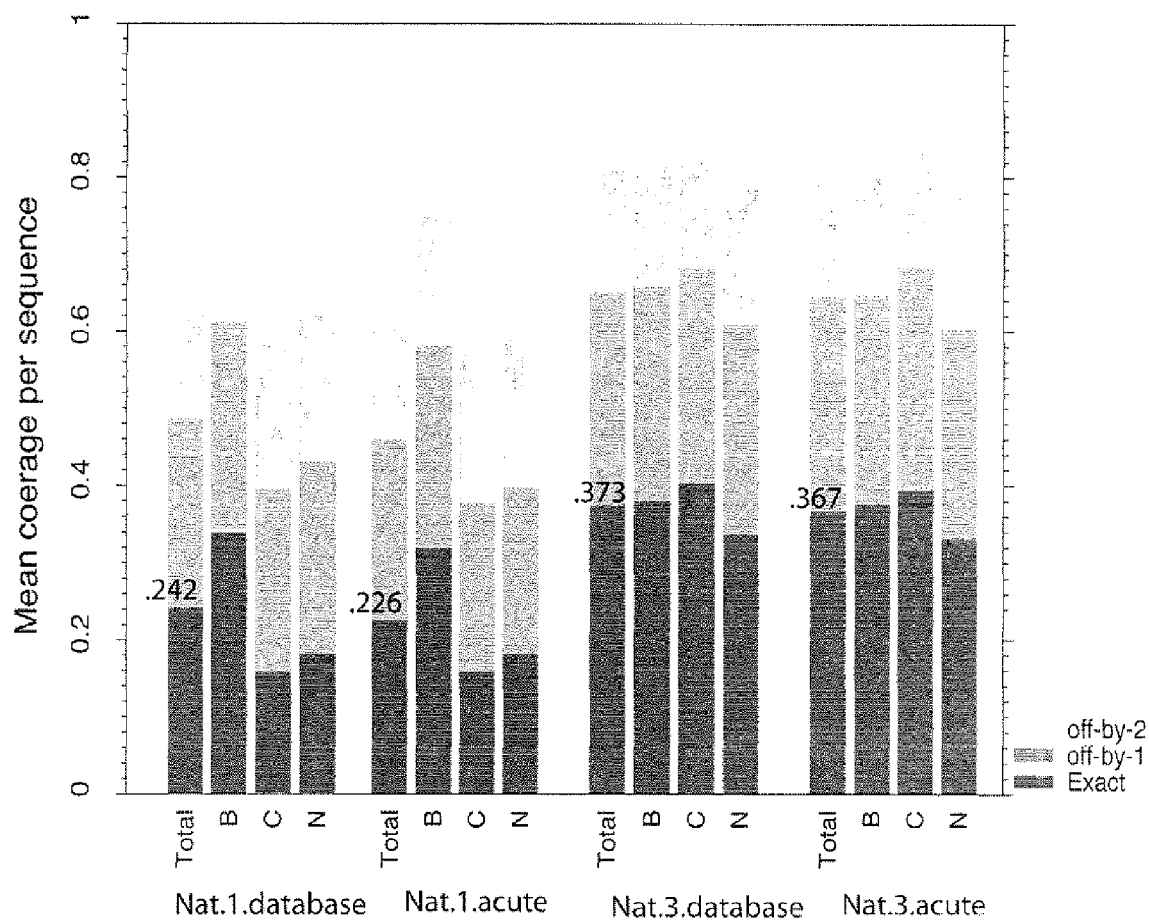

Nat.3.database

Option 1:
B YU2* -- 1986, USA
C DU467, South Africa,
A ML170 -- 1986 Kenya

Optimal for the set
after requiring inclusion
of one each of subtype
A, B and C.

Nat.3.acute

Option 2:
B 1059*
C 0393
A R66201FPB

Optimal for the set
after requiring inclusion
of one each of subtype
A, B and C as well as
restricting antigen selection
to SGA sequences sampled
during acute infection.

Fig. 18
Differences in acute infection patient sequences compared to patient consensus
i) B.1059
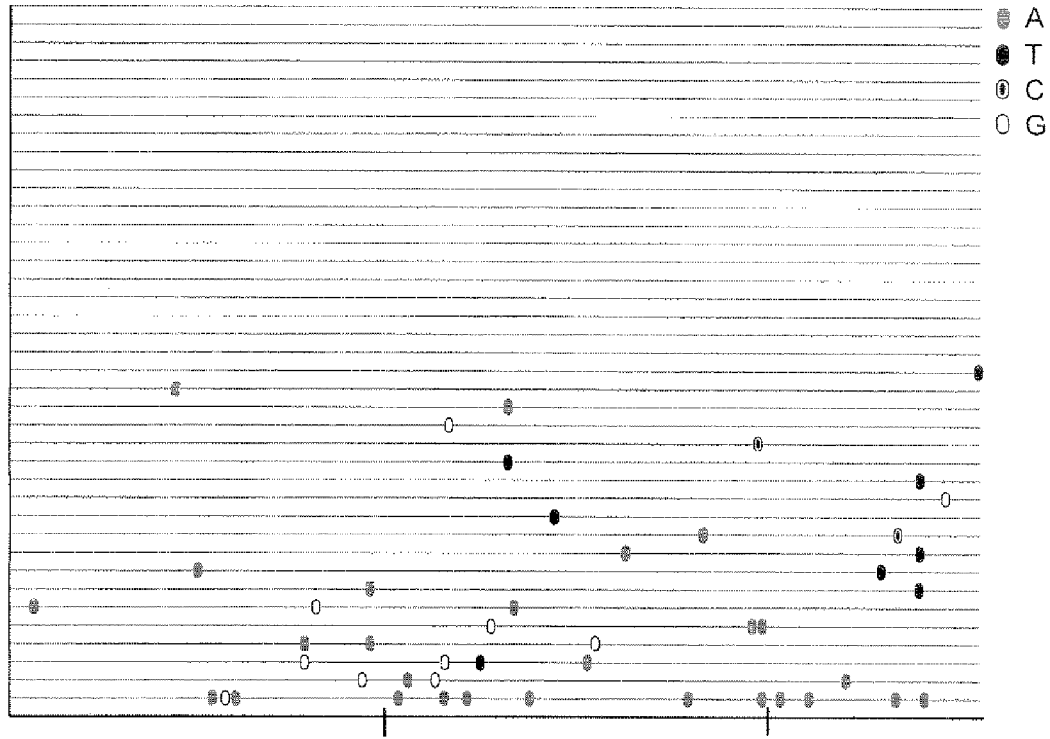
ii) C.0393
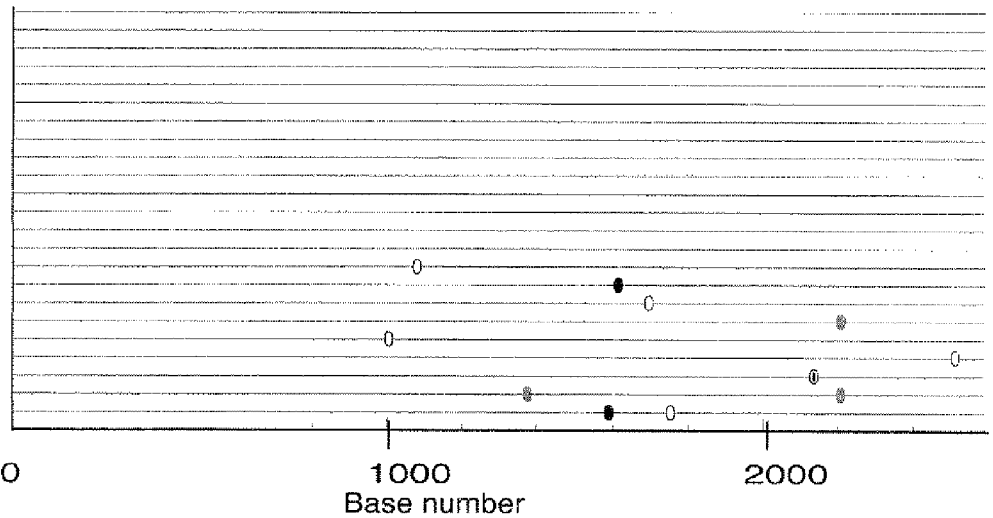

>nefM_4.1Dmyr
MAAKWSKSSIVGWPAVRERMRRAEPAADGVGAVSRDLEKHGAITSSNTAATNADCAWLEAQEE
DSEVGFPVRPHVPLRPMTYKAAVDLSHFLKEQGGLEGLIYSQKRQDILDLWVYHTQGYFPDWQN
YTPGPGIRYPLTFGWCFKLVPVDPREVEEANKGENNCLLHPMSQHGMDDPEKEVLMWKFDSRLA
FHHMAREKHPEFYKDC >nefM_4.2Dmyr
MAAKWSKRSIVGWPAIRERMRRTEPAAEGVGAASQDLDKYGALTSSNTAQTNPDCAWLEAQEE
EEVGFPVRPQVPVRPMTYKGALDLSHFLKEKGGLDGLIYSRKRQEILDLWVYNTQGYFPDWQNY
TPGPGVRYPLTFGWCYKLVPVDPEEVEKANEGENNSLLHPMSLHGMEDPEREVLKWKFDSRLAL
KHRARELHPEFYKDC >nefM_4.3Dmyr
MAANWSKSSIVGWPEIRERIRRTDPAAEGVGAASRDLERHGAITSSNTATTNAACAWLEAQEDEE
VGFPVRPQVPLRPMTFKGAFDLGFFLKEKGGLEGLIYSKKRQDILDLWVYNTQGFFPDWQNYTPG
PGTRFPLTFGWCFELVPVDPKEVEEANEGENNCLLHPICQHGMDDEEREVLMWKFDSSLARRHLA
REKHPEYYKDC >nefM_4.4Dmyr
MASKWSKSSIVGWPQVRERIRQTPPAAEGVGAVSQDLDKHGAVTSSNTAANNADCAWLQAQEE
EEEVGFPVKPQVPLRPMTYKGAFDLSFFLKEKGGLDGLIYSKKRQEILDLWVYHTQGFFPDWHNY
TPGPGTRYPLCFGWCFKLVPMDPAEVEEATEGENNSLLHPICQHGMEDEDREVLVWRFDSSLARR
HIARELHPEYYKDC >Gag-M4.1Dmyr
MAARASVLSGGELDRWEKIRLRPGGKKKYKLKHIVWASRELERFAVNPGLLETSEGCRQILGQLQ
PSLQTGSEELRSLYNTVAVLYCVHQRIDVKDTKEALEKIEEEQNKSQQKTQQAKAADGKVSQNYP
IVQNAQGQMVHQAISPRTLNAWVKVIEEKGFSPEVIPMFSALAEGATPQDLNTMLNTIGGHQAAM
QMLKDTINDEAAEWDRLHPVQAGPVAPGQIREPRGSDIAGTTSNLQEQIGWMTSNPPIPVGDIYKR
WIIMGLNKIVRMYSPTSILDIRQGPKESFRDYVDRFFRTLRAEQASQEVKNWMTETLLVQNSNPDC
KTILKALGPAATLEEMMTACQGVGGPGHKARVLAEAMSQVQQPNIMMQRGNFKGQKRIKCFNC
GREGHLARNCRAPRKKGCWKCGREGHQMKDCTESKANFLGKIWPSNKGRPGNFLQSRPEPSAPP
AESFGFGEEITPSQKQEQKDKELYPLASLKSLFGNDPLSQ >Gag_M4.2 Dmyr
MAARASVLSGGKLDAWEKIRLRPGGKKKYRLKHLVWASRELDRFALNPSLLETAEGCKQIMKQL
QPALKTGTEELKSLYNTVATLYCVHEKIDVRDTKEALDKIEEEQNKIQQKTQQAKEADGKVSQNY
PIVQNIQGQMVHQPISPRTLNAWVKVVEEKAFSPEVIPMFTALSDGATPQDLNSMLNAVGGHQAA
MQILKDTINEEAADWDRLHPVHAGPVAPGQMREPRGSDIAGTTSTLQEQIGWMTNNPPIPVGEIYK
RWIILGLNKIVRMYSPVSILDIKQGPKESFRDYVDRFFKVLRAEQATQDVKNWMTDTLLIQNANPD
CKSILRALGPGATLEEMMTACQGVGGPSHKARILAEAMSQVTNSATIMMQRGNFRNQRKTVKCF
NCGKEGHLARNCKAPRKRGCWKCGKEGHQMKECTERQANFLGKIWPSSKGRPGNFPQSRPEPTA
PPEESFRFGEETTTPSQKQEPIDKELYPLASLRSLFGNDPSSQAS

Fig. 21 cont'd-1

>Gag_M4.3 Dmyr
MAARASILRGGKLDKWEKIRLRPGGKKRYMLKHLIWASRELERFALNPGLLETAEGCQQIIEQLQS
TLKTGSEELKSLFNTVATLYCVHQRIEVKDTKEALDKVEEEQNKSKKKAQQAAADTGNSSQVSQ
NYPIVQNLQGQMVHQALSPRTLNAWVKVIEEKAFSPEIIPMFTALSEGATPSDLNTMLNTVGGHQ
AAMQMLKDTINEEAAEWDRVHPVHAGPIPPGQMREPRGSDIAGTTSSLQEQIAWMTSNPPVPVGE
IYKRWIVLGLNKIVRMYSPVSILDIRQGPKEPFRDYVDRFFKTLRAEQASQDVKNWMTETLLVQN
ANPDCKTILRALGPGASLEEMMTACQGVGGPSHKARVLAEAMSQTNSAILMQRSNFKGSKRIVKC
FNCGKEGHIARNCRAPRKRGCWKCGQEGHQMKDCNERQANFLGKIWPSHKGRPGNFLQNRPEPT
APPEPTAPPAESFRFEETTPAPKQELKDREPLTSLKSLFGSDPLSQAS >Gag_M4.4 Dmyr
MAARASVLRGEKLDKWERIRLRPGGKKHYMLKHLVWASRELEKFALNPGLLETSEGCKQIIKQL
QPALQTGTEELRSLFNTVATLYCVHAGIEVRDTKEALDKIEEIQNKSKQKTQQAAAGTGSSSKVSQ
NYPIVQNLQGQMVHQPLSPRTLNAWVKVVEEKGFNPEVIPMFSALSEGATPQDLNMMLNIVGGH
QAAMQMLKETINEEAAEWDRLHPVHAGPIAPGQMREPRGSDIAGSTSTLQEQIAWMTGNPPVPV
GDIYKRWIILGLNKIVKMYSPTSILDIKQGPKEPFRDYVDRFYKTLRAEQATQEVKNWMTDTLLVQ
NANPDCKSILKALGTGATLEEMMSACQGVGGPAHKARVLAEAMSQANNTNIMMQRSNFKGPKRI
IKCFNCGKEGHIAKNCRAPRKKGCWKCGKEGHQMKDCTERQANFLGRIWPSSKGRPGNFLQSRP
EPTAPPAEPTAPPAESFKFEETTPAPKQEPKDREPLTSLRSLFGSDPLLQAS >M_mos_3_1 (M_mos_Env_3_1)
MRVKGIRKNYQHLWRWGTMLLGMLMICSAAEQLWVTVYYGVPVWRDAETTLFCASDAKAYER
EVHNVWATHACVPTDPNPQEIVLENVTEEFNMWKNNMVDQMHEDIISLWDESLKPCVKLTPLCV
TLNCTDVNVTKTNSTSWGMMEKGEIKNCSFNMTTELRDKKQKVYALFYKLDIVPLEENDTISNST
YRLINCNTSAITQACPKVTFEPIPIHYCTPAGFAILKCNDKKFNGTGPCKNVSTVQCTHGIRPVVTTQ
LLLNGSLAEEEIIIRSENLTNNAKTIIVQLNESVVINCTRPNNNTRKSIRIGPGQTFYATGDIIGNIRQA
HCNISREKWINTTRDVRKKLQEHFNKTIIFNSSSGGDLEITTHSFNCRGEFFYCNTSKLFNSVWGNS
SNVTKVNGTKVKETITLPCKIKQIINMWQEVGRAMYAPPIAGNITCKSNITGLLLVRDGGNVTNNT
EIFRPGGGNMKDNWRSELYKYKVVEIKPLGIAPTKAKRRVVEREKRAVGLGAVFLGFLGAAGST
MGAASMTLTVQARQLLSGIVQQQSNLLRAIEAQQHMLQLTVWGIKQLQARILAVERYLRDQQLL
GIWGCSGKLICTTNVPWNSSWSNKSLDEIWNNMTWMQWEKEIDNYTSLIYTLIEESQNQQEKNEQ
DLLALDKWANLWNWFDISNWLWYIRIFIMIVGGLIGLRIVFAVLSIVNRVRKGYSPLSFQTLTPNPR
GPDRLGRIEEEGGEQDKDRSIRLVNGFLALAWDDLRNLCLFSYHRLRDLLLIVTRIVELLGRRGWE
ALKYLWNLLQYWIQELKNSAVSLLNATAIAVAEGTDRVIEVVQRACRAILHIPRRIRQGLERALL >M_mos_3_2 (M_mos_Env_3_2)
MRVKETQMNWPNLWKWGTLILGLVIICSASDNLWVTVYYGVPVWKEATTTLFCASDAKAYDTE
VHNVWATYACVPTDPNPQEVVLGNVTENFNMWKNNMVEQMHEDIISLWDQSLKPCVRLTPLCV
TLNCSNANTTNTNSTEEIKNCSFNITTSIRDKVQKEYALFYKLDVVPIDNDNTSYRLISCNTSVITQA
CPKVSFEPIPIHYCAPAGFAILKCKDKKFNGTGPCTNVSTVQCTHGIRPVVSTQLLLNGSLAEEFVVI
RSENFTNNAKTIIVHLNKSVEINCTRPNNNTRKSIHIGPGRAFYATGEIIGDIRQAHCNISRAKWNNT
LKQIVKKLKEQFNKTIIFNQSSGGDPEITTHSFNCGGEFFYCNTSGLFNSTWNSTATQESNNTELNG
NITLPCRIKQIVNMWQEVGKAMYAPPIRGQIRCSSNITGLILTRDGGNNNSTNETFRPGGGDMRDN
WRSELYKYKVVKIEPLGVAPTKAKRRVVQREKRAVGTIGAMFLGFLGAAGSTMGAASLTLTVQA
RLLLSGIVQQQNNLLRAIEAQQHLLQLTVWGIKQLQARVLAVERYLKDQQLLGIWGCSGKLICTT
TVPWNTSWSNKSLNEIWDNMTWMEWEREIDNYTGLIYTLLEESQNQQEKNEQELLELDKWASL
WNWFDITKWLWYIKIFIMIVGGLVGLRIVFTVLSIVNRVRQGYSPLSFQTHLPAPRGPDRPEGIEEE
GGERDRDRSGRLVDGFLAIIWVDLRSLCLFSYHQLRDFILIAARTVELLGHSSLKGLRRGWEALKY
WWNLLQYWSQELKNSAISLLNTTAIVVAEGTDRIIEVLQRAGRAILHIPTRIRQGLERLLL

Fig. 21 cont'd-2

>M_mos_3_3 (M_mos_Env_3_3)
MRVRGIQRNWPQWWIWGILGFWMLMICNVVGNLWVTVYYGVPVWKEAKTTLFCASDAKAYEK
EVHNVWATHACVPTDPSPQEVVLENVTENFNMWKNDMVDQMHEDVISLWDQSLKPCVKLTHL
CVTLNCTNATNTNYNNSTNVTSSMIGEMKNCSFNITTEIRDKSRKEYALFYRLDIVPLNEQNSSEY
RLINCNTSTITQACPKVSFDPIPIHYCAPAGYAILKCNNKTFNGTGPCNNVSTVQCTHGIKPVVSTQL
LLNGSLAEGEIIIRSENLTDNAKTIIVHLNESVEIVCTRPNNNTRKSVRIGPGQAFYATGDIIGDIRQA
HCNLSRTQWNNTLKQIVTKLREQFGNKTIVFNQSSGGDPEIVMHSFNCGGEFFYCNTTQLFNSTWE
NSNITQPLTLNRTKGPNDTITLPCRIKQIINMWQGVGRAMYAPPIEGLIKCSSNITGLLLTRDGGNNS
ETKTTETFRPGGGNMRDNWRNELYKYKVVQIEPLGVAPTRAKRRVVEREKRAVGIGAVFLGFLG
TAGSTMGAASITLTVQARQVLSGIVQQQSNLLKAIEAQQHLLKLTVWGIKQLQTRVLAIERYLKD
QQLLGLWGCSGKLICTTAVPWNSSWSNKSQTDIWDNMTWMQWDREISNYTDTIYRLLEDSQNQ
QEKNEKDLLALDSWKNLWNWFDITNWLWYIKIFIIIVGGLIGLRIIFAVLSIVNRCRQGYSPLSLQTL
IPNPRGPDRLGGIEEEGGEQDRDRSIRLVSGFLALAWDDLRSLCLFSYHRLRDFILIVARAVELLGRS
SLRGLQRGWEALKYLGSLVQYWGLELKKSAISLLDTIAIAVAEGTDRIIEVIQRICRAIRNIPRRIRQ
GFEAALL

Fig. 22

| HVI number | Gene name | Nef | Myristylation signal mutated |
|---|---|---|---|
| HV13236 | M.con_Nef01_Dmyr.WLV | Group M (2001) consensus | Yes |
| HV13319 | nefM_4.1Dmyr.wlv | Mosaic No. 1 | Yes |
| HV13231 | nefM_4.2Dmyr.wlv | Mosaic No. 2 | Yes |
| HV13230 | nefM_4.3Dmyr.wlv | Mosaic No. 3 | Yes |
| HV13232 | nefM_4.4Dmyr.wlv | Mosaic No. 4 | Yes |
| HV10001 | No inser | | |

All five constructs were cloned into HV10001 (WLV001AM DNA vaccine plasmid.

M.con_Nef01_Dmyr.WLV (657nt.)(hv13236), 67% GC
XhoI
CTCGAGAAGAAAATGGCGGCCAAGTGGTCGAAGAGCTCCATCGTCGGGTGGCCGGCGGTCCGGGAG
CGCATCCGGCGGACGCACCCCGCGGCCGAGGGGGTCGGCGCGGTCTCGCAAGACCTCGACAAGC
ACGGGGCGATCACGTCGAGCAACACCGCCGCGAACAACCCCGACTGCGCGTGGCTGGAGGCCCA
GGAGGAAGAGGAAGAGGTCGGCTTCCCGGTCCGCCCGCAAGTGCCGCTCAGGCCGATGACGTAC
AAGGCGGCCCTCGACCTCTCGCACTTCCTGAAAGAGAAGGGTGGCCTGGAGGGGCTCATCTACT
CGAAGAAGAGGCAGGAGATCCTCGACCTGTGGGTCTACCACACCCAGGGCTACTTCCCGGACTG
GCAGAACTACACGCCAGGCCCGGGAATCCGCTACCCGCTGACCTTCGGGTGGTGCTTCAAGCTC
GTCCCCGTCGACCCGGAGGAGGTCGAGGAAGCCAACGAGGGCGAGAACAACAGCCTCCTGCACC
CGATGTGCCAGCACGGGATGGAGGACGAGGAGCGCGAGGTGCTGATGTGGAAGTTCGACTCGCG
CCTGGCCCTGCGCCACATCGCCCGGGAGCTCCACCCGGAGTACTACAAGGACTGCTGATAAGCTA
GCGGATCCTGATCA
NheI  BamHI  BclI MAAKWSKSSIVGWPAVRERIRRTHPAAEGVGAVSQDLDKHGAITSSNTAANNPDCAWLEAQEEE
EEVGFPVRPQVPLRPMTYKAALDLSHFLKEKGGLEGLIYSKKRQEILDLWVYHTQGYFPDWQNY
TPGPGIRYPLTFGWCFKLVPVDPEEVEEANEGENNSLLHPMCQHGMEDEEREVLMWKFDSRLAL
RHIARELHPEYYKDC_

>HV13236 in hv10001, 3953nt.
AAATGGGGGCGCTGAGGTCTGCCTCGTGAACAAGGTGTTGCTGACTCATACCAGGCCTGAATCGCCCCATCATCCAG
CCAGAAAGTGAGGGAGCCACGGTTGATGAGAGCTTTGTTGTAGGTGGACCAGTTGGTGATTTTGAACTTTTGCTTTG
CCACGGAACGGTCTGCGTTGTCGGGAAGATGCGTGATCTGATCCTTCAACTCAGCAAAAGTTCGATTTATTCAACAA
AGCCGCCGTCCCGTCAAGTCAGCGTAATGCTCTGCCAGTGTTACAACCAATTAACCAATTCTGCGTTCAAAATGGTA
TGCGTTTTGACACATCCACTATATATCCGTGTCGTTCTGTCCACTCCTGAATCCCATTCCAGAAATTCTCTAGCGAT
TCCAGAAGTTTCTCAGAGTCGGAAAGTTGACCAGACATTACGAACTGGCACAGATGGTCATAACCTGAAGGAAGATC
TGATTGCTTAACTGCTTCAGTTAAGACCGACGCGCTCGTCGTATAACAGATGCGATGATGCAGACCAATCAACATGG
CACCTGCCATTGCTACCTGTACAGGTCAAGGATGGTAGAAATGTTGTCGGTCCTTGCACACGAATATTACGCCATTTG
CCTGCATATTCAAACAGCTCTTCTACGATAAGGGCACAAATCGCATCGTGGAACGTTTGGGCTTCTACCGATTTAGC
AGTTTGATACACTTTCTCTAAGTATCCACCTGAATCATAAATCGGCAAAATAGAGAAAAATTGACCATGTGTAAGCG
GCCAATCTGATTCCACCTGAGATGCATAATCTAGTAGAATCTTCGCTATCAAAATTCACTTCCACCTTCCACTCA
CCGGTTGTCCATTCATGGCTGAACTCTGCTTCCTCTGTTGACATGACACACATCATCTCAATATCCGAATACGGACC
ATCAGTCTGACGACCAAGAGAGCCATAAACACCAATAGCCTTAACATCATCCCCATATTTATCCAATATTCGTTCCT
TAATTTCATGAACAATCTTCATTCTTTCTTCTAGTCATTATTATTGGTCCGTTCATAACACCCCTTGTATTACTG
TTTATGTAAGCAGACAGTTTTATTGTTCATGATGATATATTTTTATCTTGTGCAATGTAACATCAGAGATTTTGAGA
CACAACGTGGCTTTCCCCGGCCCATGACCAAAATCCCTTAACGTGAGTTTTCGTTCCACTGAGCGTCAGACCCGTA
GAAAAGATCAAAGGATCTTCTTGAGATCCTTTTTTTCTGCGCGTAATCTGCTGCTTGCAAACAAAAAAACCACCGCT

Mosaic and Group M nef_Dmyr-Patent.doc

```
BstNI     CCWGG                    55      771    1175         25 Sites
13 Sites                     1423    1857    1875                52    1172    1520
       52    1738    1751    1886                              1738    1751    1872
 1872    2475    2668         2268    2469    2662             2475
 2977                         3073    3096    3128              2668    2977    3020
   3270    3381    3444       3168                             3138    3270    3297
 3478    3657    3801          3267    3323    3342            3381
Cfr10I    RCCGGY               3379    3481    3660              3444    3456    3478
2 Sites                      HgiAI    GWGCWC                   3483    3484    3540
      847    3128            5 Sites                           3657
CfrI      YGGCCR                    1587    2085    2953          3677    3678    3690
4 Sites                       3114    3685                     3801
    769    3094    3126      HhaI     GCGC                     NaeI     GCCGGC
 3156                         19 Sites                         1 Site
ClaI      ATCGAT                    11     496    1273            3130
1 Site                        1382    1556    1656            NciI     CCSGG
    2287                      1723                             12 Sites
DdeI      CTNAG                   1993    2026    2169             1172    1520    3020
12 Sites                      2249    3045    3047             3138    3297    3456
       12     204     397     3145                             3483
   711     787    1214  1623     3183    3255    3625             3484    3540    3677
    2088    2158    2229     3655    3667                      3678    3690
 3318    3861                HincII   GTYRAC                  NcoI     CCATGG
DpnI      GATC                5 Sites                          1 Site
13 Sites                            413     886    2369          2745
       190     195     460    3051    3536                    NdeI     CATATG
 1239    1247    1258        HinfI    GANTC                   2 Sites
 1333                         15 Sites                            2076    2619
   2972    3028    3216            43      59     357        NheI     GCTAGC
 3417    3725    3731         383    401    725   779          1 Site
DraIII    CACNNNGTG              807    1527    1923            3717
1 Site                        1938    2222    2795            NlaIII   CATG
    1161                      3487                             14 Sites
Eco47I    GGWCC                 3648                                 538     762     864
7 Sites                      HinPI    GCGC                      892    1011    1109  1181
      122     586     919    19 Sites                             1901    2219    2349
 1048    1021    1133              9     494    1271          2367    2689    2749
 3298                         1380    1554    1654             3942
EcoRII    CCWGG                1721                           NlaIV    GGNNCC
13 Sites                         1991    2024    2167         9 Sites
       50    1736    1749     2247    3043    3045                  92    540    1830
 1870    2473    2666         3143                             1869    2852    3023
 2975                            3131    3253    3623         3073
   3268    3379    3442       3653    3665                       3725    3809
 3476    3655    3799        HpaII    CCGG                    NruI     TCGCGA
EcoRV     GATATC              16 Sites                         1 Site
1 Site                              848    1172    1329          2257
    2294                      1519    1545    1692            NsiI     ATGCAT
Fnu4HI    GCNGC                3019                            1 Site
20 Sites                         3129    3137    3149             796
      234     769    1283     3297    3456    3483            Nsp7524I  RCATGY
 1489    1492    1557         3540                             2 Sites
 1700                            3677    3690                    1901    3942
   1855    1973    1976      MaeI     CTAG                   NspBII   CMGCKG
 1994    2110    2250         7 Sites                          6 Sites
 2279                               378     801    1034          1314    1559    2281
   2282    3094    3166      1404    2385    3718             3039    3165    3500
 3235    3315    3340         3751                           RsaI     GTAC
FnuDII    CGCG                MaeII    ACGT                   11 Sites
17 Sites                      12 Sites                              559    2093    2263
    494    1273    1854             669    1160    1196       2330    2604    2684
 2169    2257    2281         2306    2507    2519             2717
 2445                         2560                                 2768    2925    3333
   3039    3045    3047          2643    2724    2829         3696
 3062    3165    3183         3219    3330                   RsrII    CGGWCCG
 3237                        MaeIII   GTNAC                   2 Sites
   3255    3625    3653      8 Sites                             3134    3299
HaeII     RGCGCY                   270    1134    1361       SacI     GAGCTC
3 Sites                       1477    1540    2446             3 Sites
       12    1657    2027    2533                                2953    3114    3685
HaeIII    GGCC               2882                            SacII    CCGCGG
20 Sites                     MvaI     CCNGG                    3 Sites
```

Mosaic and Group M nef_Dmyr-Patent.doc

Fig. 22 cont'd-3

```
        2282      3040      3166         1 Site                        SinI       GGWCC
SalI          GTCGAC                       3696                        7 Sites
2 Sites                                  ScrFI      CCNGG                  123       587       920
        3049      3534                  25 Sites                         1049      3022      3134
Sau3A         GATC                           52      1172      1520       3299
13 Sites                                   1738      1751      1872    SmaI       CCCGGG
         188       193       458           2475                        2 Sites
        1237      1245      1256           2668      2977      3020        3484      3678
        1331                                3138      3270      3297    SnaBI      TACGTA
        2970      3026      3214           3381                        1 Site
        3415      3723      3729           3444      3456      3478       2729
Sau96A        GGNCC                        3483      3484      3540    SpeI       ACTAGT
17 Sites                                   3657                        1 Site
         123       587       920           3677      3678      3690       2384
        1049      1174      2266           3801                        SphI       GCATGC
        2458                             SdnI       GDGCHC              1 Site
        2661      3022      3071         8 Sites                          3942
        3072      3134      3266            652      1587      2085    SspI       AATATT
        3299                               2953      3075      3114    2 Sites
        3341      3480      3659           3391                            603       991
ScaI          AGTACT                       3685                        StuI       AGGCCT
1 Site
          55
StyI          CCWWGG
1 Site
        2745
TaqI          TCGA
15 Sites
         216      1799      2287
        3050      3079      3105
        3199
        3222      3346      3399
        3421      3535      3550
        3645
        3738
XhoI          CTCGAG
1 Site
        3078
XhoII         RGATCY
5 Sites
         458      1245      1256
        3415      3723
XmaI          CCCGGG
2 Sites
        3482      3678
XmaIII        CGGCCG
1 Site
        3166
XmnI          GAANNNNTTC
1 Site
         811
Following enzymes have no
sites
AccIII     AflII     Asp718
AsuII      AvrII     BalI
BbeI       BspMII    BstEII
BstXI      DraI
Eco47III
EcoO109    EcoRI     EspI
FspI       HindIII   HpaI
KpnI       MluI      MstI
NarI       NotI      OxaNI
PflMI      PpuMI     PssI
PstI       PvuI      PvuII
SfiI       SplI      Tth111I
XbaI       XcaI
```

Mosaic and Group M nef_Dmyr-Patent.doc

Fig. 22 cont'd-4 nefM_4.1Dmyr (hv13225 in), (663nt.), GC=67%
CTCGAGAAGAAA`ATG`GCGGCCAAGTGGTCGAAGAGCTCCATCGTCGGGTGGCCGGCGGTCCGGGAGAGGA
TGCGGAGGGCGGAGCCGGCGGCCGACGGGGTCGGGGCGGTCTCGCGGGACCTGGAGAAGCACGGGGCGAT
CACGTCGAGCAACACCGCCGCGACGAACGCGGACTGCGCGTGGCTGGAGGCCCAGGAGGAGGACTCGGAG
GTCGGCTTCCCGGTCCGGCCGCACGTCCCGCTCCGGCCGATGACGTACAAGGCGGCCGTCGACCTCTCCC
ACTTCCTGAAAGAGCAGGGGGGCCTGGAGGGGCTCATCTACTCGCAGAAGAGGCAGGACATCCTCGACCT
GTGGGTCTACCACACCCAGGGCTACTTCCCGGACTGGCAGAACTACACGCCAGGCCCGGGAATCCGCTAC
CCGCTGACCTTCGGGTGGTGCTTCAAGCTCGTCCCCGTGGACCCGCGGGAGGTCGAGGAAGCCAACAAGG
GGGAGAACAACTGCCTCCTGCACCCGATGTCGCAGCACGGGATGGACGACCCGGAGAAGGAGGTGCTGAT
GTGGAAGTTCGACTCGCGGCTGGCGTTCCACCACATGGCCCGCGAGAAGCACCCGGAGTTCTACAAGGAC
TGCTGATAAG`CTAGC`TGATCAGGATCCACGCGT MAAKWSKSSIVGWPAVRERMRRAEPAADGVGAVSRDLEKHGAITSSNTAATNADCAWLEAQEEDSFVGFP
VRPHVPLRPMTYKAAVDLSHFLKEQGGLEGLIYSQKRQDILDLWVYHTQGYFPDWQNYTPGPGIRYPLTF
GWCFKLVPVDPREVEEANKGENNCLLHPMSQHGMDDPEKEVLMWKFDSRLAFHHMAREKHPEFYKDC_

HV13319 (nefM_4.1Dmyr.wlv), 3918nt.
AAATGGGGGCGCTGAGGTCTGCCTCGTGAAGAAGGTGTTGCTGACTCATACCAGGCCTGAATCGCCCCAT
CATCCAGCCAGAAAGTGAGGGAGCCACGGTTGATGAGAGCTTTGTTGTAGGTGGACCAGTTGGTGATTTT
GAACTTTTGCTTTGCCACGGAACGGTCTGCGTTGTCGGGAAGATGCGTGATCTGATCCTTCAACTCAGCA
AAAGTTCGATTTATTCAACAAAGCCGCCGTCCCGTCAAGTCAGCGTAATGCTCTGCCAGTGTTACAACCA
ATTAACCAATTCTGCGTTCAAAATGGTATGCGTTTTGACACATCCACTATATATCCGTGTCGTTCTGTCC
ACTCCTGAATCCCATTCCAGAAATTCTCTAGCGATTCCAGAAGTTTCTCAGAGTCGGAAAGTTGACCAGA
CATTACGAACTGGCACAGATGGTCATAACCTGAAGGAAGATCTGATTGCTTAACTGCTTCAGTTAAGACC
GACGCGCTCGTCGTATAACAGATGCGATGATGCAGACCAATCAACATGGCACCTGCCATTGCTACCTGTA
CAGTCAAGGATGGTAGAAATGTTGTCGGTCCTTGCACACGAATATTACGCCATTTGCCTGCATATTCAAA
CAGCTCTTCTACGATAAGGGCACAAATCGCATCGTGGAACGTTTGGGCTTCTACCGATTTAGCAGTTTGA
TACACTTTCTCTAAGTATCCACCTGAATCATAAATCGGCAAATAGAGAAAATTGACCATGTGTAAGCG
GCCAATCTGATTCCACCTGAGATGCATAATCTAGTAGAATCTCTTCGCTATCAAAATTCACTTCCACCTT
CCACTCACCGGTTGTCCATTCATGGCTGAACTCTGCTTCCTCTGTTGACATGACACACATCATCTCAATA
TCCGAATACGGACCATCAGTCTGACGACCAAGAGAGCCATAAACACCAATAGCCTTAACATCATCCCCAT
ATTTATCCAATATTCGTTCCTTAATTTCATGAACAATCTTCATTCTTTCTTCTAGTCATTATTATTGG
TCCGTTCATAACACCCCTTGTATTACTGTTTATGTAAGCAGACAGTTTTATTGTTCATGATGATATATTT
TTATCTTGTGCAATGTAACATCAGAGATTTTGAGACACAACGTGGCTTTCCCCGGCCCATGACCAAAATC
CCTTAACGTGAGTTTTCGTTCCACTGAGCGTCAGACCCCGTAGAAAAGATCAAAGGATCTTCTTGAGATC
CTTTTTTTCTGCGCGTAATCTGCTGCTTGCAAACAAAAAAACCACCGCTACCAGCGGTGGTTTGTTTGCC
GGATCAAGAGCTACCAACTCTTTTTCCGAAGGTAACTGGCTTCAGCAGAGCGCAGATACCAAATACTGTT
CTTCTAGTGTAGCCGTAGTTAGGCCACCACTTCAAGAACTCTGTAGCACCGCCTACATACCTCGCTCTGC
TAATCCTGTTACCAGTGGCTGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACAGCCCAGCTTGGAGCGAACG
ACCTACACCGAACTGAGATACCTACAGCGTGAGCTATGAGAAAGCGCCACGCTTCCCGAAGGGAGAAAGG
CGGACAGGTATCCGGTAAGCGGCAGGGTCGGAACAGGAGAGCGCACGAGGGAGCTTCCAGGGGGAAACGC
CTGGTATCTTTATAGTCCTGTCGGGTTTCGCCACCTCTGACTTGAGCGTCGATTTTTGTGATGCTCGTCA
GGGGGCGGAGCCTATGGAAAAACGCCAGCAACGCGGCCTTTTTACGGTTCCTGGCCTTTTGCTGGCCTT
TTGCTCACATGTTCTTTCCTGCGTTATCCCCTGATTCTGTGGATAACCGTATTACCGCCTTTGAGTGAGC
TGATACCGCTCGCCGCAGCCGAACGACCGAGCGCAGCGAGTCAGTGAGCGAGGAAGCGGAAGAGCGCCTG
ATGCGGTATTTTCTCCTTACGCATCTGTGCGGTATTTCACACCGCATATGGTGCACTCTCAGTACAATCT
GCTCTGATGCCGCATAGTTAAGCCAGTATCTGCTCCCTGCTTGTGTGTTGGAGGTCGCTGAGTAGTGCGC
GAGCAAAACTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCATACGTT
GTATCTATATCATAATATGTACATTTATATTGGCTCATGTCCAATATGACCGCCATGTTGACATTGATTA

Fig. 22 cont'd-5

```
TTGACTAGTTATTAATAGTAATCAATTACGGGGTCATTAGTTCATAGCCCATATATGGAGTTCCGCGTTA
CATAACTTACGGTAAATGGCCCGCCTGGCTGACCGCCCAACGACCCCCGCCCATTGACGTCAATAATGAC
GTATGTTCCCATAGTAACGCCAATAGGGACTTTCCATTGACGTCAATGGGTGGAGTATTTACGGTAAACT
GCCCACTTGGCAGTACATCAAGTGTATCATATGCCAAGTCCGCCCCCTATTGACGTCAATGACGGTAAAT
GGCCCGCCTGGCATTATGCCCAGTACATGACCTTACGGGACTTTCCTACTTGGCAGTACATCTACGTATT
AGTCATCGCTATTACCATGGTGATGCGGTTTTGGCAGTACATCAATGGGCGTGGATAGCGGTTTGACTCA
CGGGGATTTCCAAGTCTCCACCCCATTGACGTCAATGGGAGTTTGTTTTGGCACCAAAATCAACGGGACT
TTCCAAAATGTCGTAACAACTCCGCCCCATTGACGCAAATGGGCGGTAGGCGTGTACGGTGGGAGGTCTA
TATAAGCAGAGCTCGTTTAGTGAACCGTCAGATCGCCTGGAGACGCCATCCACGCTGTTTTGACCTCCAT
AGAAGACACCGGGACCGATCCAGCCTCCGCGGGCGCGCGTCGAGAAGAAAATGGCGGCCAAGTGGTCGAA
GAGCTCCATCGTCGGGTGGCCGGCGGTCCGGGAGAGGATGCGGAGGGCGGAGCCGGCGGCCGACGGGGTC
GGGGCGGTCTCGCGGGACCTGGAGAAGCACGGGCGATCACGTCGAGCAACACCGCCGCGACGAACGCGG
ACTGCGCGTGGCTGGAGGCCCAGGAGGAGGACTCGGAGGTCGGCTTCCCGGTCCGGCCGCACGTCCCGCT
CCGGCCGATGACGTACAAGGCGGCCGTCGACCTCTCCCACTTCCTGAAAGAGCAGGGGGGCCTGGAGGGG
CTCATCTACTCGCAGAAGAGGCAGGACATCCTCGACCTGTGGGTCTACCACACCCAGGGCTACTTCCCGG
ACTGGCAGAACTACACGCCAGGCCCGGGAATCCGCTACCCGCTGACCTTCGGGTGGTGCTTCAAGCTCGT
CCCCGTGGACCCGCGGGAGGTCGAGGAAGCCAACAAGGGGGAGAACAACTGCCTCCTGCACCCGATGTCG
CAGCACGGGATGGACGACCCGGAGAAGGAGGTGCTGATGTGGAAGTTCGACTCGCGGCTGGCGTTCCACC
ACATGGCCCGCGAGAAGCACCCGGAGTTCTACAAGGACTGCTGATAAGCTAGCTGATCAGCCTCGACTGT
GCCTTCTAGTTGCCAGCCATCTGTTGTTTGCCCCTCCCCCGTGCCTTCCTTGACCCTGGAAGGTGCCACT
CCCACTGTCCTTTCCTAATAAAATGAGGAAATTGCATCGCATTGTCTGAGTAGGTGTCATTCTATTCTGG
GGGGTGGGGTGGGCAGGACAGCAAGGGGGAGGATTGGGAAGACAATAGCAGGCATGCTGGGGAATTT
```

```
Thursday, August 2, 2007              2953    3085    3362           3169    3241    3352
                                      BclI    TGATCA                 3415    3449    3766
Sequence 0   Length : 3918             1 Site                         Cfr10I  RCCGGY
                                        3694                          3 Sites
AatII     GACGTC                      BcnI    CCSGG                     847    3099    3132
4 Sites                               10 Sites                        CfrI    YGGCCR
  2510    2563    2646                  1173    1521    3021          7 Sites
2832                                    3110    3269    3428             769    3065    3097
AccI      GTMKAC                        3455                            3137    3274    3292
2 Sites                                 3456    3590    3662            3311
  3317    3404                        BglI    GCCNNNNNGGC              ClaI    ATCGAT
AflIII    ACRYGT                      3 Sites                         1 Site
1 Site                                  2475    2597    2668            2287
  1897                                BglII   AGATCT                  DdeI    CTNAG
AluI      AGCT                        1 Site                          11 Sites
13 Sites                                458                              12     204     397
   109     633    1340                Bsp1286 GDGCHC                    711     787    1214    1623
  1597    1643    1733                6 Sites                          2098    2158    2229
  1959                                   652    1587    2085          3826
  2184    2951    3083                  2953    3085    3362          DpnI    GATC
  3495    3683    3692                BspHI   TCATGA                  11 Sites
AlwNI     CAGNNNCTG                   2 Sites                            190     195     460
2 Sites                                 1007    1105                    1239    1247    1258
  1489    2129                        BspNI   CCWGG                    1333
AosII     GRCGYC                      13 Sites                          2972    3028    3187
5 Sites                                   52    1738    1751          3696
  2507    2560    2643                  1872    2475    2668          DraIII  CACNNNGTG
  2829    2983                          2977                          1 Site
ApaLI     GTGCAC                        3169    3241    3352            1161
2 Sites                                 3415    3449    3766          Eco47I  GGWCC
  1563    2081                        BssHII  GCGCGC                  9 Sites
AvaI      CYCGRG                      1 Site                             122     586     919
1 Site                                  3045                           1048    3021    3104
  3453                                 BstNI   CCWGG                   3164
BanI      GGYRCC                      13 Sites                          3269    3506
3 Sites                                   52    1738    1751          EcoO109 RGGNCCY
   538    2850    3772                  1872    2475    2668          2 Sites
BanII     GRGCYC                        2977                            3165    3348
3 Sites                                                               EcoRII  CCWGG Mosaic and CON nef_Dmyr_final.doc
```

Fig. 22 cont'd-6

```
13 Sites                        9      494    1271    NlaIV     GGNNCC
     50     1736    1749     1380    1554    1654    11 Sites
  1870    2473    2666       1721                         92     540    1830
  2975                          1991    2024    2167    1869    2852    3023
  3167    3239    3350       2247    3043    3045    3131
  3413    3447    3764       3224                         3165    3349    3509
EcoRV     GATATC            HpaII    CCGG              3774
1 Site                       17 Sites                  NruI      TCGCGA
     2294                         848    1172    1329    1 Site
Fnu4HI    GCNGC              1519    1545    1692         2257
22 Sites                      3019                       NsiI      ATGCAT
    234     769    1283      3100    3108    3133    1 Site
  1489    1492    1557       3268    3273    3291         796
  1700                          3427                       Nsp7524I  RCATGY
  1855    1973    1976       3454    3589    3661    2 Sites
  1994    2110    2250       MaeI      CTAG              1901    3907
  2279                          7 Sites                  NspBII    CMGCKG
  2282    3065    3137            378     801    1034    6 Sites
  3206    3277    3311       1404    2385    3689       1314    1559    2281
  3571                          3716                       3039    3471    3513
  3625                       MaeII     ACGT              PflMI     CCANNNNNTGG
FnuDII    CGCG               13 Sites                  1 Site
17 Sites                          669    1160    1196         3642
    494    1273    1854      2306    2507    2519    PpuMI     RGGWCCY
  2169    2257    2281       2560                         1 Site
  2445                          2643    2724    2829         3165
  3039    3045    3047       3190    3281    3301    PssI      RGGNCCY
  3162    3208    3217       MaeIII    GTNAC             2 Sites
  3226                          8 Sites                       3168    3351
  3513    3624    3650            270    1134    1361    RsaI      GTAC
HaeII     RGCGCY             1477    1540    2446    10 Sites
3 Sites                       2533                            559    2093    2263
     12    1657    2027       2882                         2330    2604    2684
HaeIII    GGCC               MvaI      CCNGG             2717
20 Sites                      23 Sites                       2768    2925    3304
     55     771    1175           52    1172    1520    RsrII     CGGWCCG
  1423    1857    1875       1738    1751    1872    2 Sites
  1886                          2475                            3105    3270
  2268    2469    2662       2668    2977    3020    SacI      GAGCTC
  3067    3099    3139       3109    3169    3241    2 Sites
  3238                          3268                            2953    3085
  3276    3294    3313       3352    3415    3427    SacII     CCGCGG
  3350    3452    3645       3449    3454    3455    3 Sites
HgiAI     GWGCWC              3589                            2282    3040    3514
4 Sites                       3661    3766              SalI      GTCGAC
  1587    2085    2953       NaeI      GCCGGC            1 Site
  3085                          2 Sites                       3316
HhaI      GCGC               3101    3134              Sau3A     GATC
14 Sites                      NciI      CCSGG             11 Sites
     11     496    1273      10 Sites                         188     193     458
  1382    1556    1656       1172    1520    3020    1237    1245    1250
  1723                          3109    3268    3427    1331
  1993    2026    2169       3454                            2970    3026    3135
  2249    3045    3047       3455    3589    3661    3694
  3226                       NcoI      CCATGG            Sau96A    GGNCC
HincII    GTYRAC             1 Site                       17 Sites
4 Sites                           2745                            123     587     920
    413     886    2369      NdeI      CATATG            1049    1174    2266
  3318                          2 Sites                       2468
HinfI     GANTC              2076    2619              2661    3022    3105
16 Sites                      NheI      GCTAGC            3165    3237    3270
     43      59     357      1 Site                       3348
    383     401     725    779    3688                            3451    3507    3645
    807    1527    1923      NlaIII    CATG              ScrFI     CCNGG
  1998    2222    2795       15 Sites                      23 Sites
  3250                            538     762     864         52    1172    1520
  3458    3619                892    1011    1109    1181  1738    1751    1872
HinPI     GCGC               1901    2219    2349    2475
14 Sites                      2367    2685    2749    2668    2977    3020
                                 3645                            3109    3169    3241
                                 3907                            3268

Mosaic and CON nef_Dmyr_final.doc
```

Fig. 22 cont'd-7

| | | | | | | | | |
|---|---|---|---|---|---|---|---|---|
| 3352 | 3415 | 3427 | | 3907 | | | 3453 | |
| 3449 | 3454 | 3455 | SspI | AATATT | | XmaIII | CGGCCG | |
| 3589 | | | 2 Sites | | | 4 Sites | | |
| 3661 | 3766 | | 603 | 991 | | 3137 | 3274 | 3292 |
| SdnI | GDGCHC | | StuI | AGGCCT | | 3311 | | |
| 6 Sites | | | 1 Site | | | XmnI | GAANNNNTTC | |
| 652 | 1587 | 2085 | 55 | | | 1 Site | | |
| 2953 | 3085 | 3352 | StyI | CCWWGG | | 811 | | |
| SinI | GGWCC | | 1 Site | | | | | |
| 9 Sites | | | 2745 | | | Following enzymes have no sites | | |
| 123 | 587 | 920 | TaqI | TCGA | | AccIII | AflII | ApaI |
| 1049 | 3022 | 3105 | 11 Sites | | | Asp718 | AsuII | AvrII |
| 3165 | | | 216 | 1799 | 2287 | BalI | BamHI | BbeI |
| 3270 | 3507 | | 3050 | 3076 | 3193 | BspMII | BstEII | BstXI |
| SmaI | CCCGGG | | 3317 | | | DraI | Eco47III | EcoRI |
| 1 Site | | | 3392 | 3521 | 3617 | EspI | PspI | HindIII |
| 3455 | | | 3703 | | | HpaI | KpnI | MluI |
| SnaBI | TACGTA | | Tth111I | GACNNNGTC | | NotI | NarI | NcoI |
| 1 Site | | | 1 Site | | | OxaNI | PstI | PvuI |
| 2725 | | | 3145 | | | PvuII | ScaI | SfiI |
| SpeI | ACTAGT | | XhoII | RGATCY | | SplI | XbaI | XcaI |
| 1 Site | | | 3 Sites | | | XhoI | | |
| 2384 | | | 458 | 1245 | 1256 | | | |
| SphI | GCATGC | | XmaI | CCCGGG | | | | |
| 1 Site | | | 1 Site | | | | | | nefM_4.2Dmyr (654nt.) hv13231, GC=66%
ctcgagAAGAAAATGGCGGCCAAGTGGTCGAAGCGGTCCATCGTCGGGTGGCCGGCGATCCGGGAGAGGA
TGCGGAGGACGGAGCCGGCGGCCGAGGGGGTCGGGGCGGCGTCGCAGGACCTCGACAAATACGGGGCGCT
CACGTCGAGCAACACCGCCCAGACGAACCCGGACTGCGCGTGGCTGGAGGCCCAGGAGGAGGAAGAGGTC
GGCTTCCCCGGTCCGGCCGCAAGTCCCAGTCAGGCCGATGACGTACAAGGGCGCCCTGGACCTCTCCCACT
TCCTGAAAGAGAAGGGGGGCCTGGACGGGCTCATCTACTCGCGGAAGAGGCAGGAGATCCTCGACCTGTG
GGTCTACAACACCCAGGGCTACTTCCCCGACTGGCAGAACTACACGCCAGGCCCCGGAGTGCGGTACCCG
CTGACCTTCGGGTGGTGCTACAAGCTCGTCCCCGTGGACCCGGAGGAGGTCGAGAAGGCCAACGAGGGGG
AGAACAACTCCCTCCTGCACCCGATGTCGCTCCACGGGATGGAGGACCCCGAGAGGGAGGTGCTCAAGTG
GAAGTTCGACTCGCGGCTGGCGCTCAAGCACCGGGCCCGGGAGCTCCACCCGGAGTTCTACAAGGACTGC
TGATAAGCTAGCGGATCCTGATCA MAAKWSKRSIVGWPAIRERMRRTEPAAEGVGAASQDLDKYGALTSSNTAQTNPDCAWLEAQEEEEVGFPV
RPQVPVRPMTYKGALDLSHFLKEKGGLDGLIYSRKRQEILDLWVYNTQGYFPDWQNYTPGPGVRYPLTFG
WCYKLVPVDPEEVEKANEGENNSLLHPMSLHGMEDPEREVLKWKFDSRLALKHRARELHPEFYKDC_

>HV13231 in hv10001 (nefM_4.2Dmyr.wlv), 3950nt.
AAATGGGGCGCTGAGGTCTGCCTCGTGAAGAAGGTGTTGCTGACTCATACCAGGCCTGAATCGCCCCAT
CATCCAGCCAGAAAGTGAGGGAGCCACGGTTGATGAGAGCTTTGTTGTAGGTGGACCAGTTGCTGATTTT
GAACTTTTGCTTTGCCACGGAACGGTCTGCGTTGTCGGGAAGATGCGTGATCTGATCCTTCAACTCAGCA
AAAGTTCGATTTATTCAACAAAGCCGCCGTCCCGTCAAGTCAGCGTAATGCTCTGCCAGTGTTACAACCA
ATTAACCAATTCTGCGTTCAAAATGGTATGCGTTTTGACACATCCACTATATATCCGTGTCGTTCTGTCC
ACTCCTGAATCCCATTCCAGAAATTCTCTAGCGATTCCAGAAGTTTCTCAGAGTCGGAAAGTTGACCAGA
CATTACGAACTGGCACAGATGGTCATAACCTGAAGGAAGATCTGATTGCTTAACTGCTTCAGTTAAGACC
GACGCGCTCGTCGTATAACAGATGCGATGATGCAGACCAATCAACATGGCACCTGCCATTGCTACCTGTA
CAGTCAAGGATGGTAGAAATGTTGTCGGTCCTTGCACACGAATATTACGCCATTTGCCTGCATATTCAAA
CAGCTCTTCTACGATAAGGGCACAAATCGCATCGTGGAACGTTTGGCTTCTACCGATTTAGCAGTTTCA
TACACTTTCTCTAAGTATCCACCTGAATCATAAATCGGCAAAATAGAGAAAAATTGACCATGTGTAAGCG
GCCAATCTGATTCCACCTGAGATGCATAATCTAGTAGAATCTCTTCGCTATCAAAATTCACTTCCACCTT
CCACTCACCGGTTGTCCATTCATGGCTGAACTCTGCTTCCTCTGTTGACATGACACACATCATCTCAATA
TCCGAATACGGACCATCACTCTGACGACCAAGAGAGCCATAAACACCAATAGCCTTAACATCATCCCCAT Mosaic and CON nef_Dmyr_final.doc

Fig. 22 cont'd-8

```
ATTTATCCAATATTCGTTCCTTAATTTCATGAACAATCTTCATTCTTTCTTCTCTAGTCATTATTATTGG
TCCGTTCATAACACCCCTTGTATTACTGTTTATGTAAGCAGACAGTTTTATTGTTCATGATGATATATTT
TTATCTTGTGCAATGTAACATCAGAGATTTTGAGACACAACGTGGCTTTCCCCGGCCCATGACCAAAATC
CCTTAACGTGAGTTTTCGTTCCACTGAGCGTCAGACCCCGTAGAAAAGATCAAAGGATCTTCTTGAGATC
CTTTTTTTCTGCGCGTAATCTGCTGCTTGCAAACAAAAAAACCACCGCTACCAGCGGTGGTTTGTTTGCC
GGATCAAGAGCTACCAACTCTTTTTTCCGAAGGTAACTGGCTTCAGCAGAGCGCAGATACCAAATACTGTT
CTTCTAGTGTAGCCGTAGTTAGGCCACCACTTCAAGAACTCTGTAGCACCGCCTACATACCTCGCTCTGC
TAATCCTGTTACCAGTGGCTGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACAGCCCAGCTTGGAGCGAACG
ACCTACACCGAACTGAGATACCTACAGCGTGAGCTATGAGAAAGCGCCACGCTTCCCGAAGGGAGAAAGG
CGGACAGGTATCCGGTAAGCGGCAGGGTCGGAACAGGAGAGCGCACGAGGGAGCTTCCAGGGGGAAACGC
CTGGTATCTTTATAGTCCTGTCGGGTTTCGCCACCTCTGACTTGAGCGTCGATTTTTGTGATGCTCGTCA
GGGGGGCGGAGCCTATGGAAAAACGCCAGCAACGCGGCCTTTTTACGGTTCCTGGCCTTTTGCTGGCCTT
TTGCTCACATGTTCTTTCCTGCGTTATCCCCTGATTCTGTGGATAACCGTATTACCGCCTTTGAGTGAGC
TGATACCGCTCGCCGCAGCCGAACGACCGAGCGCAGCGAGTCAGTGAGCGAGGAAGCGGAAGAGCGCCTG
ATGCGGTATTTTCTCCTTACGCATCTGTGCGGTATTTCACACCGCATATGGTGCACTCTCAGTACAATCT
GCTCTGATGCCGCATAGTTAAGCCAGTATCTGCTCCCTGCTTGTGTGTTGGAGGTCGCTGACTAGTGCGC
GAGCAAAATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCATACGTT
GTATCTATATCATAATATGTACATTTATATTGGCTCATGTCCAATATGACCGCCATGTTGACATTGATTA
TTGACTAGTTATTAATAGTAATCAATTACGGGGTCATTAGTTCATAGCCCATATATGGAGTTCCGCGTTA
CATAACTTACGGTAAATGGCCCGCCTGGCTGACCGCCCAACGACCCCCGCCCATTGACGTCAATAATGAC
GTATGTTCCCATAGTAACGCCAATAGGGACTTTCCATTGACGTCAATGGGTGGAGTATTTACGGTAAACT
GCCCACTTGGCAGTACATCAAGTGTATCATATGCCAAGTCCGCCCCCTATTGACGTCAATGACGGTAAAT
GGCCCGCCTGGCATTATGCCCAGTACATGACCTTACGGGACTTTCCTACTTGGCAGTACATCTACGTATT
AGTCATCGCTATTACCATGGTGATGCGGTTTTGGCAGTACATCAATGGGCGTGGATAGCGGTTTGACTCA
CGGGGATTTCCAAGTCTCCACCCCATTGACGTCAATGGGAGTTTGTTTTGGCACCAAAATCAACGGGACT
TTCCAAAATGTCGTAACAACTCCGCCCCATTGACGCAAATGGGCGGTAGGCGTGTACGGTGGGAGGTCTA
TATAAGCAGAGCTCGTTTAGTGAACCGTCAGATCGCCTGGAGACGCCATCCACGCTGTTTTGACCTCCAT
AGAAGACACCGGGACCGATCCAGCCTCCGCGGGCGCGCGTCGACGGGCGACGCGAAACTTGGGCCCACTC
GAGAAGAAAATGGCGGCCAAGTGGTCGAAGCGGTCCATCGTCGGGTGGCCGGCGATCCGGGAGAGGATGC
GGAGGACGGAGCCGGCGGCCGAGGGGGTCGGGGCGGCGTCGCAGGACCTCGACAAATACGGGGCGCTCAC
GTCGAGCAACACCGCCCAGACGAACCCGGACTGCGCGTGGCTGGAGGCCCAGGAGGAGGAAGAGGTCGGC
TTCCCGGTCCGGCCGCAAGTCCCAGTCAGGCCGATGACGTACAAGGGCGCCCTGGACCTCTCCCACTTCC
TGAAAGAGAAGGGGGGCCTGGACGGGCTCATCTACTCGCGGAAGAGGCAGGAGATCCTCGACCTGTGGGT
CTACAACACCCAGGGCTACTTCCCCGACTGGCAGAACTACACGCCAGGCCCCGGAGTGCGGTACCCGCTG
ACCTTCGGGTGGTGCTACAAGCTCGTCCCCGTGGACCCGGAGGAGGTCGAGAAGGCCAACGAGGGGGAGA
ACAACTCCCTCCTGCACCCGATGTCGCTCCACGGGATGGAGGACCCCGAGAGGGAGGTGCTGAAGTGGAA
GTTCGACTCGCGGCTGGCGCTCAAGCACCGGGCCCGGGAGCTCCACCCGGAGTTCTACAAGGACTGCTGA
TAAGCTAGCGGATCCTGATCAGCCTCGACTGTGCCTTCTAGTTGCCAGCCATCTGTTGTTTGCCCCTCCC
CCGTGCCTTCCTTGACCCTGGAAGGTGCCACTCCCACTGTCCTTTCCTAATAAAATGAGGAAATTGCATC
GCATTGTCTGAGTAGGTGTCATTCTATTCTGGGGGGTGGGGTGGGGCAGCACAGCAAGGGGAGGATTGG
GAAGACAATAGCAGGCATGCTGGGGAATTT
```

| Thursday, August 2, 2007 | AflIII | ACRYGT | | 2 Sites | | |
|---|---|---|---|---|---|---|
| | 1 Site | | | 1483 | 2129 | |
| Sequence 9  Length : 3950 | 1897 | | | AosII | GRCGYC | |
| | AluI | AGCT | | 7 Sites | | |
| AatII  GACGTC | 12 Sites | | | 2507 | 2560 | 2643 |
| 4 Sites | | 109 | 633  1340 | 2829 | 2983 | 3186 |
| 2510  2563  2646 | 1597 | 1643  1733 | | 3537 | | |
| 2832 | 1959 | | | ApaI | GGGCCC | |
| AccI  GTMKAC | | 2184  2951  3521 | | 2 Sites | | |
| 2 Sites | 3600 | 3714 | | 3075 | 3674 | |
| 3050  3430 | AlwNI | CAGNNNCTG | | ApaLI | GTGCAC | |

Mosaic and CON nef_Dmyr_final.doc

Fig. 22 cont'd-9

```
2 Sites                      ClaI      ATCGAT           3267      3302      3320
   1583      2081            1 Site                     3376      3478      3655
Asp718    GGTACC                2287                    3672
1 Site                       DdeI      CTNAG            HgiAI     GWGCWC
   3490                      11 Sites                   4 Sites
AvaI      CYCGRG                12       204       397     1587      2085      2953
3 Sites                         711      787      1214      1623   3682
   3078      3615    3673       2098     2158      2229           HhaI      GCGC
BamHI     GGATCC                3858                             17 Sites
1 Site                       DpnI      GATC                         11      496       1273
   3720                      13 Sites                               1382     1556      1656
BanI      GGYRCC                190      195       460              1723
5 Sites                         1239     1247      1258             1993     2026      2169
   538      2850     3336       1333                                2249     3045      3047
   3490     3804                2972     3028      3135             3215
BanII     GRGCYC                3414     3722      3728             3255     3339      3659
5 Sites                      DraIII    CACNNNGTG                 HincII    GTYRAC
   2953     3075     3388    1 Site                              4 Sites
   3674     3682                1161                                413      886       2369
BbeI      GGCGCC             Eco47I    GGWCC                        3051
1 Site                       11 Sites                           HinfI     GANTC
   3340                         122      586       919           14 Sites
BclI      TGATCA                1048     3021      3111             43       59        357
1 Site                          3193                                383      401       725       779
   3726                         3295     3343      3532             807      1527      1923
BcnI      CCSGG                 3610                                1998     2222      2795
12 Sites                     EcoO109   RGGNCCY                      3645
   1173     1521     3021    4 Sites                             HinPI     GCGC
   3139     3247     3295       3194     3374      3477          17 Sites
   3482                         3611                                9        494       1271
   3538     3670     3675    EcoRII    CCWGG                        1380     1554      1654
   3676     3688             13 Sites                               1721
BglI      GCCNNNNNGGC           50       1736      1749             1991     2024      2167
3 Sites                         1870     2473      2666             2247     3043      3045
   2475     2597     2668       2975                                3213
BglII     AGATCT                3268     3340      3376             3253     3337      3657
1 Site                          3439     3473      3796          HpaII     CCGG
   458                       EcoRV     GATATC                    18 Sites
Bsp1286   GDGCHC             1 Site                                 848      1172      1329
8 Sites                         2294                                1519     1545      1692
   652      1587     2085    Fnu4HI    GCNGC                        3019
   2953     3075     3388    20 Sites                               3129     3137      3162
   3674                         234      769       1283             3246     3294      3299
   3682                         1489     1492      1557             3481
BspHI     TCATGA                1700                                3537     3668      3674
2 Sites                         1855     1973      1976             3687
   1007     1105                1994     2110      2250          KpnI      GGTACC
BspNI     CCWGG                 2279                             1 Site
13 Sites                        2282     3094      3166             3494
   52       1738     1751       3184     3303      3653          MaeI      CTAG
   1872     2475     2568    FnuDII    CGCG                      7 Sites
   2977                      14 Sites                               372      801       1034
   3270     3342     3375       494      1273      1854             1404     2385      3715
   3441     3475     3798       2169     2257      2281             3748
BssHII    GCGCGC                2445                             MaeII     ACGT
1 Site                          3039     3045      3047          12 Sites
   3045                         3062     3255      3398             669      1160      1196
BstNI     CCWGG                 3650                                2306     2507      2519
13 Sites                     HaeII     RGCGCY                       2560
   52       1738     1751    6 Sites                                2643     2724      2829
   1872     2475     2568       12       1657      2027             3219     3327
   2977                         3216     3340      3660          MaeIII    GTNAC
   3270     3342     3378    HaeIII    GGCC                      8 Sites
   3441     3475     3798    21 Sites                               270      1134      1361
Cfr10I    RCCGGY                55       771       1175             1477     1540      2446
3 Sites                         1423     1857      1875             2533
   847      3128     3161       1886                                2882
CfrI      YGGCCR                2268     2469      2562          MvaI      CCNGG
5 Sites                         3073     3096      3128          25 Sites
   769      3094     3128       3168
   3166     3300
```

Mosaic and CON nef_Dmyr_final doc

Fig. 22 cont'd-10

```
         52    1172    1520      PpuMI     RGGWCCY           11 Sites
 1738   1751    1872              2 Sites                       123     587     920
 2475                              3194    3611             1049    3022    3112
         2668    2977    3020     PssI      RGGNCCY          3194
 3138   3246    3270              4 Sites                       3296    3344    3533
 3294                              3197    3377    3480     3611
         3342    3378    3441     3614                       SmaI      CCCGGG
 3475   3481    3537              RsaI      GTAC             1 Site
 3669                              11 Sites                      3676
         3674    3675    3687      559    2093    2263      SnaBI     TACGTA
 3798                              2330    2604    2684      1 Site
 NaeI      GCCGGC                  2717                         2725
 2 Sites                            2768    2926    3330     SpeI      ACTAGT
  3130    3163                     3492                       1 Site
 NarI      GGCGCC                  RsrII     CGGWCCG             2384
 1 Site                            1 Site                    SphI      GCATGC
   3337                             3296                      1 Site
 NciI      CCSGG                   SacI      GAGCTC              3939
 12 Sites                          2 Sites                   SspI      AATATT
  1172    1520    3020             2953    3682              2 Sites
 3138    3246    3294              SacII     CCGCGG            603     991
 3481                              2 Sites                   StuI      AGGCCT
  3537    3669    3674             2282    3040              1 Site
 3675    3687                      SalI      GTCGAC              55
 NcoI      CCATGG                  1 Site                    StyI      CCWWGG
 1 Site                             3049                      1 Site
   2745                            Sau3A     GATC                2745
 NdeI      CATATG                  13 Sites                  TaqI      TCGA
 2 Sites                            188    193    458        12 Sites
  2076    2619                    1237    1245    1256        216    1799    2237
 NheI      GCTAGC                 1331                       3050    3079    3105
 1 Site                             2970    3026    3133     3199
   3714                           3412    3720    3726         3222    3418    3547
 NlaIII    CATG                    Sau96A    GGNCC           3643    3735
 14 Sites                          22 Sites                  XhoI      CTCGAG
   538    762    664                123    587    920        1 Site
  892   1011   1109    1181       1049    1174    2266          3078
   1901    2219    2349          2468                        XhoII     RGATCY
 2307    2689    2749              2661    3022    3071      5 Sites
 3939                             3072    3112    3194          458    1245    1256
 NlaIV     GGNNCC                 3266                       3412    3720
 17 Sites                          3296    3344    3374      XmaI      CCCGGG
   92    540    1830              3477    3533    3611      1 Site
 1869    2852    3023             3670                          3673
 3073                             3671                       XmaIII    CGGCCG
   3160    3336    3375           ScrFI     CCNGG            2 Sites
 3479    3492    3535             25 Sites                   3166    3300
 3613                               52    1172    1520       XmnI      GAANNNNTTC
   3672    3722    3806           1738   1751    1872        1 Site
 NruI      TCGCGA                 2475                          811
 1 Site                             2668    2977    3020
   2257                           3138    3246    3270       Following enzymes have no
 NsiI      ATGCAT                 3294                       sites
 1 Site                             3342    3378    3441     AccIII    AflII    AsuII
   796                            3475    3481    3537       AvrII     BalI     BspMII
 Nsp7524I  RCATGY                 3669                       BstEII    BstXI    DraI
 2 Sites                            3674    3675    3687     Eco47III  EcoRI    EspI
  1901    3939                    3798                       FspI      HindIII  HpaI
 NspBII    CMGCKG                 SdnI      GDGCHC           MluI      MstI     NotI
 5 Sites                          8 Sites                    OxaNI     PstI     PvuI
  1314    1559    2281             652    1587    2085       PvuII     ScaI     SfiI
 3039    3497                     2953    3075    3388       SplI      Tth111I  XbaI
 PflMI     CCANNNNNTGG            3674                       XcaI
 1 Site                            3682
   3605                           SinI      GGWCC
```

>nefM_4.3Dmyr(654nt.), hv13230, GC=66%
ctcgagAAGAAAATCGCGGCCAACTGGTCGAAGAGCTCCATCGTCGGGTGGCCGGAGATCCGGGAGCGCA
TCCGGAGGACGGACCCGGCCGCCGAGGGGGTCGGGGCCGCCCTCGCGGGACCTGGAGCGCCACGGGGCGAT

Fig. 22 cont'd-11

```
CACGTCGAGCAACACCGCCACCACGAACGCGGCCTGCGCGTGGCTGGAGGCCCAGGAGGACGAGGAAGTC
GGCTTCCCGGTCCGGCCGCAAGTCCCGCTCAGGCCGATGACGTTCAAGGGGGCCTTCGACCTCGGCTTCT
TCCTGAAAGAGAAGGGGGGCCTGGAGGGGCTCATCTACTCGAAGAAGAGGCAGGACATCCTCGACCTGTG
GGTCTACAACACCCAGGGGTTCTTCCCGGACTGGCAGAACTACACGCCAGGCCCGGGAACCCGGTTCCCG
CTGACCTTCGGGTGGTGCTTCGAGCTCGTCCCCGTGGACCCGAAGGAGGTCGAGGAAGCCAACGAGGGGG
AGAACAACTGCCTCCTGCACCCGATCTGCCAGCACGGGATGGACGACGAGGAGCGCGAGGTGCTGATGTG
GAAGTTCGACTCGTCCCTGGCCCGGCGCCACCTCGCCCGGGAGAAGCACCCGGAGTACTACAAGGACTGC
TGATAAGCTAGCGGATCCTGATCA

MAANWSKSSIVGWPEIRERIRRTDPAAEGVGAASRDLERHGAITSSNTATTNAACAWLEAQEDEFVGFPV
RPQVPLRPMTFKGAFDLGFFLKEKGGLEGLIYSKKRQDILDLWVYNTQGFFPDWQNYTPGPGTRFPLTFG
WCFELVPVDPKEVEEANEGENNCLLHPICQHGMDDEEREVLMWKFDSSLARRHLAREKHPEYYKDC

>hv13230 in hv10001 (nefM_4.3Dmyr.wlv) (3950nt.)
AAATGGGGGCGCTGAGGTCTGCCTCGTGAAGAAGGTGTTGCTGACTCATACCAGGCCTGAATCGCCCCAT
CATCCAGCCAGAAAGTGAGGGAGCCACGGTTGATGAGAGCTTTGTTGTAGGTGGACCAGTTGGTGATTTT
GAACTTTTGCTTTGCCACGGAACGGTCTGCGTTGTCGGGAAGATGCGTGATCTGATCCTTCAACTCAGCA
AAAGTTCGATTTATTCAACAAAGCCGCCGTCCCGTCAAGTCAGCGTAATGCTCTGCCAGTGTTACAACCA
ATTAACCAATTCTGCGTTCAAAATGGTATGCGTTTTGACACATCCACTATATATCCGTGTCGTTCTGTCC
ACTCCTGAATCCCATTCCAGAAATTCTCTAGCGATTCCAGAAGTTTCTCAGAGTCGGAAAGTTGACCAGA
CATTACGAACTGGCACAGATGGTCATAACCTGAAGGAAGATCTGATTGCTTAACTGCTTCAGTTAAGACC
GACGCGCTCGTCGTATAACAGATGCGATGATGCAGACCAATCAACATGGCACCTGCCATTGCTACCTGTA
CAGTCAAGGATGGTAGAAATGTTGTCGGTCCTTGCACACGAATATTACGCCATTTGCCTGCATATTCAAA
CAGCTCTTCTACGATAAGGGCACAAATCGCATCGTGGAACGTTTGGGCTTCTACCGATTTAGCAGTTTGA
TACACTTTCTCTAAGTATCCACCTGAATCATAAATCGGCAAAATAGAGAAAAATTGACCATGTGTAAGCG
GCCAATCTGATTCCACCTGAGATGCATAATCTAGTAGAATCTCTTCGCTATCAAAATTCACTTCCACCTT
CCACTCACCGGTTGTCCATTCATGGCTGAACTCTGCTTCCTCTGTTGACATGACACACATCATCTCAATA
TCCGAATACGGACCATCAGTCTGACGACCAAGAGAGCCATAAACACCAATAGCCTTAACATCATCCCCAT
ATTTATCCAATATTCGTTCCTTAATTTCATGAACAATCTTCATTCTTTCTTCTAGTCATTATTATTGG
TCCGTTCATAACACCCCTTGTATTACTGTTTATGTAAGCAGACAGTTTTATTGTTCATGATGATATATTT
TTATCTTGTGCAATGTAACATCAGAGATTTTGAGACACAACGTGGCTTTCCCCGGCCCATGACCAAAATC
CCTTAACGTGAGTTTTCGTTCCACTGAGCGTCAGACCCCGTAGAAAAGATCAAAGGATCTTCTTGAGATC
CTTTTTTTCTGCGCGTAATCTGCTGCTTGCAAACAAAAAAACCACCGCTACCAGCGGTGGTTTGTTTGCC
GGATCAAGAGCTACCAACTCTTTTTCCGAAGGTAACTGGCTTCAGCAGAGCGCAGATACCAAATACTGTT
CTTCTAGTGTAGCCGTAGTTAGGCCACCACTTCAAGAACTCTGTAGCACCGCCTACATACCTCGCTCTGC
TAATCCTGTTACCAGTGGCTGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACAGCCCAGCTTGGAGCGAACG
ACCTACACCGAACTGAGATACCTACAGCGTGAGCTATGAGAAAGCGCCACGCTTCCCGAAGGGAGAAAGG
CGGACAGGTATCCGGTAAGCGGCAGGGTCGGAACAGGAGAGCGCACGAGGGAGCTTCCAGGGGGAAACGC
CTGGTATCTTTATAGTCCTGTCGGGTTTCGCCACCTCTGACTTGAGCGTCGATTTTTGTGATGCTCGTCA
GGGGGCGGAGCCTATGGAAAAACGCCAGCAACGCGGCCTTTTTACGGTTCCTGGCCTTTTGCTGGCCTT
TTGCTCACATGTTCTTTCCTGCGTTATCCCCTGATTCTGTGGATAACCGTATTACCGCCTTTGAGTGAGC
TGATACCGCTCGCCGCAGCCGAACGACCGAGCGCAGCGAGTCAGTGAGCGAGGAAGCGGAAGAGCGCCTG
ATGCGGTATTTTCTCCTTACGCATCTGTGCGGTATTTCACACCGCATATGGTGCACTCTCAGTACAATCT
GCTCTGATGCCGCATAGTTAAGCCAGTATCTGCTCCCTGCTTGTGTGTTGGAGGTCGCTGAGTAGTGCGC
GAGCAAATTTAAGCTACAACAAGGCAAGGCTTGACCGACAATTGCATGAAGAATCTGCTTAGGGTTAGG
CGTTTGCGCTGCTTCGCGATGTACGGGCCAGATATAGCCGCGGCATCGATGATATCCATTGCATACGTT
GTATCTATATCATAATATGTACATTTATATTGGCTCATGTCCAATATGACCGCCATGTTGACATTGATTA
TTGACTAGTTATTAATAGTAATCAATTACGGGGTCATTAGTTCATAGCCCATATATGGAGTTCCGCGTTA
CATAACTTACGGTAAATGGCCCGCCTGGCTGACCGCCCAACGACCCCCGCCCATTGACGTCAATAATGAC
GTATGTTCCCATAGTAACGCCAATAGGGACTTTCCATTGACGTCAATGGGTGGAGTATTTACGGTAAACT
```

Mosaic and CON nef_Dmyr_final.doc

Fig. 22 cont'd-12

```
GCCCACTTGGCAGTACATCAAGTGTATCATATGCCAAGTCCGCCCCCTATTGACGTCAATGACGGTAAAT
GGCCCGCCTGGCATTATGCCCAGTACATGACCTTACGGGACTTTCCTACTTGGCAGTACATCTACGTATT
AGTCATCGCTATTACCATGGTGATGCGGTTTTGGCAGTACATCAATGGGCGTGGATAGCGGTTTGACTCA
CGGGGATTTCCAAGTCTCCACCCCATTGACGTCAATGGGAGTTTGTTTTGGCACCAAAATCAACGGGACT
TTCCAAAATGTCGTAACAACTCCGCCCCATTGACGCAAATGGGCGGTAGGCGTGTACGGTGGGAGGTCTA
TATAAGCAGAGCTCGTTTAGTGAACCGTCAGATCGCCTGGAGACGCCATCCACGCTGTTTGACCTCCAT
AGAAGACACCGGGACCGATCCAGCCTCCGCGGCGCGCGTCGACGGGCGACGCGAAACTTGGGCCCACTC
GAGAAGAAATGGCGGCCAACTGGTCGAAGAGCTCCATCGTCGGGTGGCCGGAGATCCGGGAGCGCATCC
GGAGGACGGACCCGGCGCCCGAGGGGGTCGGGCGGCCTCGCGGGACCTGGAGCGCCACGGGGCGATCAC
GTCGAGCAACACCGCCACCACGAACGCGGCCTGCGCGTGGCTGGAGGCCCAGGAGGACGAGGAACTCGCC
TTCCCGGTCCGGCCGCAAGTCCCGCTCAGGCCGATGACGTTCAAGGGGGCCTTCGACCTCGGCTTCTTCC
TGAAAGAGAAGGGGGGCCTGGAGGGGCTCATCTACTCGAAGAAGAGGCAGGACATCCTCGACCTGTGCCT
CTACAACACCCAGGGGTTCTTTCCCGGACTGGCAGAACTACACGCCAGGCCCGGGAACCCGGTTCCCGCTG
ACCTTCGGGTGGTGCTTCGAGCTCGTCCCCGTGGACCCGAAGGAGGTCGAGGAAGCCAACGAGGGGGAGA
ACAACTGCCTCCTGCACCCGATCTGCCAGCACGGGATGGACGACGAGGAGCGCGAGGTGCTGATGTGGAA
GTTCGACTCGTCCCTGGCCCGGCGCCACCTCGCCCGGGAGAAGCACCCGGAGTACTACAAGGACTGCTGA
TAAGCTAGCGGATCCTGATCAGCCTCGACTGTGCCTTCTAGTTGCCAGCCATCTGTTGTTTGCCCCTCCC
CCGTGCCTTCCTGACCCTGGAAGGTGCCACTCCCACTGTCCTTTCCTAATAAAATGAGGAAATTGCATC
GCATTGTCTGAGTAGGTGTCATTCTATTCTGGGGGGTGGGGTGGGCAGGACAGCAAGGGGCAGGATTGG
GAAGACAATAGCAGGCATGCTGGGGAATTT
```

```
Thursday, August 2, 2007              BanI      GGYRCC              52      1738     1781
                                      4 Sites                      1872    2475     2668
Sequence 0   Length : 3950               538     2850     3661     2977
                                      3804                          3198    3270     3376
AatII       GACGTC                    BanII     GRGCYC              3441    3475     3654
4 Sites                               5 Sites                      3798
   2510    2563     2646                2953    3075     3114     BssHII    GCGCGC
2832                                  3388     3523                1 Site
AccI        GTMKAC                    BbeI      GGCGCC                3045
2 Sites                               1 Site                      BstNI     CCWGG
   3050    3430                          3665                      14 Sites
AccIII      TCCGGA                    BclI      TGATCA                52     1738     1781
1 Site                                1 Site                      1872     2475     2668
   3148                                  3726                      2977
AflIII      ACRYGT                    BcnI      CCSGG                 3198    3270     3378
1 Site                                14 Sites                    3441     3475     3654
   1897                                  1173    1521     3021    3798
AluI        AGCT                      3139     3163     3295     CfrI0I    RCCGGY
12 Sites                              3454                        1 Site
    109     633     1340              3481     3482     3489        817
   1597    1643     1733              3660     3675     3676     CfrI      YGGCCR
   1959                               3689                        5 Sites
   2184    2951     3112              BglI      GCCNNNNNGGC           769    3094     3126
   3521    3714                       3 Sites                      3166    3300
AlwNI       CAGNNNCTG                    2475    2597     2668     ClaI      ATCGAT
2 Sites                               BglII     AGATCT              1 Site
   1488    2129                       1 Site                         2257
AosII       GRCGYC                       458                       DdeI      CTNAG
6 Sites                               Bsp1286   GDGCHC              12 Sites
   2507    2560     2643              8 Sites                         12     204      397
2829    2983     3662                    652    1587     2085        711    787      1214    1623
ApaI        GGGCCC                       2953    3075     3114       2088    2158     2229
1 Site                                3388                           3315    3858
   3075                                  3523                      DpnI      GATC
ApaLI       GTGCAC                    BspHI     TCATGA              14 Sites
2 Sites                               2 Sites                         190    195      460
   1503    2031                          1007    1105              1239     1247     1256
AvaI        CYCGRG                    BspMII    TCCGGA              1333
3 Sites                               1 Site                       2972     3028     3135
   3078    3479     3673                 3148                      3216     3591     3722
BamHI       GGATCC                    BspNI     CCWGG               3728
1 Site                                14 Sites                    DraIII    CACNNNGTG
   3720                                                            1 Site
```

Mosaic and CON nef_Dmyr_final.doc

Fig. 22 cont'd-13

```
1161                          4 Sites                        3480    3482    3488
Eco47I    GGWCC                    413     886     2369     3659    3674    3675
9 Sites                       3051                           3687
     122     586     919     HinfI    GANTC                  NcoI    CCATGG
1048    3021    3157          14 Sites                       1 Site
3193                               43      59      357          2745
    3295    3532                  383     401     729     779 NdeI    CATATG
Eco0109   RGGNCCY                 807    1527    1923         2 Sites
3 Sites                          1998    2222    2795            2076    2619
    3194    3337    3374         3645                        NheI    GCTAGC
EcoRII    CCWGG               HinPI     GCGC                 1 Site
14 Sites                      18 Sites                          3714
      50    1736    1749            9     494    1271       NlaIII   CATG
1870    2473    2666          1380    1554    1654           14 Sites
2975                          1721                                538     762     864
    3196    3268    3376         1901    2024    2167         892    1011    1109    1181
3439    3473    3652          2247    3043    3045              1901    2219    2349
3796                          3143                               2367    2689    2749
EcoRV     GATATC                  3203    3253    3620       3939
1 Site                        3662                           NlaIV    GGNNCC
    2294                      HpaII    CCGG                  17 Sites
Fnu4HI    GCNGC               19 Sites                           92     540    1830
20 Sites                          848    1172    1329        1869    2852    3023
     234     769    1283      2519    1545    1692           3073
1489    1492    1557          3019                               3160    3195    3333
1700                             3129    3137    3149        3375    3485    3492
    1855    1973    1976      3162    3294    3299           3535
1994    2110    2250          3453                               3663    3722    3809
2279                             3480    3488    3659        NruI     TCGCGA
    2282    3094    3166      3674    3687                   1 Site
3184    3247    3303          MaeI     CTAG                     2257
FnuDII    CGCG                7 Sites                        NsiI     ATGCAT
15 Sites                          378     801    1034        1 Site
     494    1273    1654      1404    2385    3715              796
2169    2257    2281          3748                           Nsp7524I RCATGY
2445                          MaeII    ACGT                  2 Sites
    3039    3045    3047      12 Sites                          1901    3939
3062    3291    3246               669    1160    1196       NspBII   CMGCKG
3255                          2306    2507    2519           5 Sites
    3622                      2560                               1314    1559    2281
HaeII     RGCGCY                  2643    2724    2829       3039    3497
5 Sites                       3219    3327                   PpuMI    RGGWCCY
      12    1657    2027      MaeIII   GTNAC                 1 Site
3206    3655                  8 Sites                           3194
HaeIII    GGCC                     270    1134    1351       PssI     RGGNCCY
23 Sites                      1477    1540    2446           3 Sites
      55     771    1175      2533                               3197    3340    3377
1423    1857    1875              2882                       RsaI     GTAC
1886                          MvaI     CCNGG                 10 Sites
    2268    2469    2662      28 Sites                           559    2093    2263
3073    3096    3128                52    1172    1520       2330    2604    2684
3168                          1738    1751    1872           2717
    3186    3249    3267      2475                               2768    2925    3693
3302    3520    3339              2668    2977    3020       RsrII    CGGWCCG
3376                          3138    3162    3198           1 Site
    3478    3657              3270                               3296
HgiAI     GWGCWC                  3294    3378    3441       SacI     GAGCTC
5 Sites                       3453    3475    3480           3 Sites
    1587    2085    2953      3481                               2953    3114    3523
3114    3523                      3488    3654    3659       SacII    CCGCGG
HheI      GCGC                3674    3675    3687           2 Sites
18 Sites                      3798                               2282    3040
      11     496    1273      NarI     GGCGCC                SalI     GTCGAC
1382    1556    1656          1 Site                         1 Site
1723                             3662                            3049
    1993    2026    2169      NciI     CCSGG                 Sau3A    GATC
2249    3045    3047          14 Sites                       14 Sites
3145                             1172    1520    3020             188     193     458
    3205    3255    3622      3138    3162    3294           1237    1245    1256
3664                          3453                           1331
HincII    GTYRAC
Mosaic and CON nef_Dmyr_final.doc
```

Fig. 22 cont'd-14

```
           2970    3026    3133                 3523                        3343    3396    3418
  3214     3589    3720              SinI       GGWCC            3517       3547    3643
  3726                                9 Sites                    3735
Sau96A     GGNCC                        123      587     920     XhoI       CTCGAG
20 Sites                             1049       3022    3158     1 Site
     123    587    920               3194                           3078
  1049     1174   2266                  3296    3533             XhoII      RGATCY
  2468                               SmaI       CCCGGG           5 Sites
  2661     3022   3071                2 Sites                       458     1245    1256
  3072     3158   3194                  3481    3675             3133       3720
  3266                               SnaBI      TACGTA           XmaI       CCCGGG
  3296     3337   3374                1 Site                     2 Sites
  3477     3533   3656                  2725                        3479    3673
ScaI       AGTACT                    SpeI       ACTAGT           XmaIII     CGGCCG
1 Site                                1 Site                     2 Sites
     3593                               2384                        3166    3300
ScrFI      CCNGG                     SphI       GCATGC           XmnI       GAANNNNTTC
28 Sites                              1 Site                     1 Site
      52   1172   1520                  3939                        811
  1738    1751    1972               SspI       AATATT
  2475                                2 Sites                    Following enzymes have no
  2668    2977    3020                   603     991             sites
  3138    3162    3198               StuI       AGGCCT           AflII      Asp718    AsuII
  3270                                1 Site                     AvrII      BalI      BstEII
  3294    3378    3441                    55                     BstXI      DraI
  3453    3475    3480               StyI       CCWWGG           Eco47III   EcoRI     EspI
  3481                                 1 Site                    FspI
  3488    3654    3659                   2745                    HindIII    HpaI      KpnI
  3674    3675    3687               TaqI       TCGA             MluI       MstI      NaeI
  3798                                14 Sites                   NotI       OxaNI     PflMI
SdnI       GDGCHC                       216    1799     2287     PstI       PvuI      PvuII
8 Sites                              3050      3079     3106     SfiI       SplI      Tth111I
     652   1587   2085               3222                        XbaI       XcaI
  2953    3075    3114
  3386
``` nefM_4.4Dmyr (657nt.) hv13232, GC=66%
ctcgagAAGAAA[ATG]GCCTCCAAGTGGTCGAAGAGCTCCATCGTCGGGTGGCCGCAAGTCCGGGAGCGCA
TCCGGCAGACGCCCCCGCGGCCGAGGGGGTCGGCGCGGTCTCGCAGGACCTCGACAAGCACGGGGCGGT
CACGTCGAGCAACACCGCCGCGAACAACGCGGACTGCGCGTGGCTGCAGGCCCAGGAGGAAGAGGAAGAG
GTCGGCTTCCCGGGTCAAGCCGCAAGTGCCGCTCAGGCCGATGACCTACAAGGGGGCCTTCGACCTCTCGT
TCTTCCTGAAAGAGAAGGGTGGCCTGGACGGGCTCATCTACTCGAAGAAGAGGCAGGAGATCCTCGACCT
GTGGGTCTACCACACCCAGGGGTTCTTCCCGGACTGGCACAACTACACGCCAGGCCCGGGAACCCGCTAC
CCGCTGTGCTTCGGGTGGTGCTTCAAGCTCGTCCCCATGGACCCGGCCGAGGTCGAGGAAGCCACCGAGG
GCGAGAACAACTCCCTCCTGCACCCGATCTGCCAGCACGGGATGGAGGACGAGGACCGCGAGGTGCTGGT
CTGGCGGTTCGACTCGTCCCTGGCCCGGCGCCACATCGCCCGGGAGCTCCACCCGGAGTACTACAAGGAC
TGCTGATAAGCTAGCGGATCCTGATCA MASKWSKSSIVGWPQVRERIRQTPPAAEGVGAVSQDLDKHGAVTSSNTAANNADCAWLQAQEEEEEVGFP
VKPQVPLRPMTYKGAFDLSFFLKEKGGLDGLIYSKKRQEILDLWVYHTQGFFPDWHNYTPGPGTRYPLCF
GWCFKLVPMDPAEVEEATEGENNSLLHPICQHGMEDEDREVLVWRFDSSLARRHIARELHPEYYKDC_

>HV13232 in hv10001 (nefM_4.4Dmyr.wlv), 3953nt.
AAATGGGGCGCGCTGAGGTCTGCCTCGTGAAGAAGGTGTTGCTGACTCATACCAGGCCTGAATCGCCCAT
CATCCAGCCAGAAAGTGAGGGAGCCACCGTTGATGAGAGCTTTGTTGTAGGTGGACCAGTTGGTGATTTT
GAACTTTTGCTTTGCCACGGAACGGTCTGCGTTGTCGGCAAGATGCGTGATCTGATCCTTCAACTCAGCA
AAAGTTCGATTTATTCAACAAAGCCGCCGTCCCGTCAAGTCAGCGTAATGCTCTGCCAGTGTTACAACCA
ATTAACCAATTCTGCGTTCAAAATGGTATGCGTTTTGACACATCCACTATATATCCGTGTCGTTCTGTCC
ACTCCTGAATCCCATTCCAGAAATTCTCTAGCGATTCCAGAAGTTTCTCAGAGTCGGAAAGTTGACCAGA
CATTACGAACTGGCACAGATGGTCATAACCTGAGGAAGATCTGATTGCTTAACTGCTTCAGTTAAGACC Mosaic and CON nef_Dmyr_final.doc

Fig. 22 cont'd-15

```
GACGCGCTCGTCGTATAACAGATGCGATGATGCAGACCAATCAACATGGCACCTGCCATTGCTACCTGTA
CAGTCAAGGATGGTAGAAATGTTGTCGGTCCTTGCACACGAATATTACGCCATTTGCCTGCATATTCAAA
CAGCTCTTCTACGATAAGGGCACAAATCGCATCGTGGAACGTTTGGGCTTCTACCGATTTAGCAGTTTGA
TACACTTTCTCTAAGTATCCACCTGAATCATAAATCGGCAAAATAGAGAAAAATTGACCATGTGTAAGCG
GCCAATCTGATTCCACCTGAGATGCATAATCTAGTAGAATCTCTTCGCTATCAAAATTCACTTCCACCTT
CCACTCACCGGTTGTCCATTCATGGCTGAACTCTGCTTCCTCTGTTGACATGACACACATCATCTCAATA
TCCGAATACGGACCATCAGTCTGACGACCAAGAGAGCCATAAACACCAATAGCCTTAACATCATCCCCAT
ATTTATCCAATATTCGTTCCTTAATTTCATGAACAATCTTCATTCTTTCTTCTCTAGTCATTATTATTGG
TCCGTTCATAACACCCCTTGTATTACTGTTTATGTAAGCAGACAGTTTTATTGTTCATGATGATATATTT
TTATCTTGTGCAATGTAACATCAGAGATTTTGAGACACAACGTGGCTTTCCCCGGCCCATGACCAAAATC
CCTTAACGTGAGTTTTCGTTCCACTGAGCGTCAGACCCCGTAGAAAAGATCAAAGGATCTTCTTGAGATC
CTTTTTTTCTGCGCGTAATCTGCTGCTTGCAAACAAAAAAACCACCGCTACCAGCGGTGGTTTGTTTGCC
GGATCAAGAGCTACCAACTCTTTTTCCGAAGGTAACTGGCTTCAGCAGAGCGCAGATACCAAATACTGTT
CTTCTAGTGTAGCCGTAGTTAGGCCACCACTTCAAGAACTCTGTAGCACCGCCTACATACCTCGCTCTGC
TAATCCTGTTACCAGTGGCTGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACAGCCCAGCTTGGAGCGAACG
ACCTACACCGAACTGAGATACCTACAGCGTGAGCTATGAGAAAGCGCCACGCTTCCCGAAGGGAGAAAGG
CGGACAGGTATCCGGTAAGCGGCAGGGTCGGAACAGGAGAGCGCACGAGGGAGCTTCCAGGGGAAACGC
CTGGTATCTTTATAGTCCTGTCGGGTTTCGCCACCTCTGACTTGAGCGTCGATTTTTGTGATGCTCGTCA
GGGGGGCGGAGCCTATGGAAAAACGCCAGCAACGCGGCCTTTTTACGGTTCCTGGCCTTTTGCTGGCCTT
TTGCTCACATGTTCTTTCCTGCGTTATCCCCTGATTCTGTGGATAACCGTATTACCGCCTTTGAGTGAGC
TGATACCGCTCGCCGCAGCCGAACGACCGAGCGCAGCGAGTCAGTGAGCGAGGAAGCGGAAGAGCGCCTG
ATGCGGTATTTTCTCCTTACGCATCTGTGCGGTATTTCACACCGCATATGGTGCACTCTCAGTACAATCT
GCTCTGATGCCGCATAGTTAAGCCAGTATCTGCTCCCTGCTTGTGTGTTGGAGGTCGCTGAGTAGTGCGC
GAGCAAAATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCATACGTT
GTATCTATATCATAATATGTACATTTATATTGGCTCATGTCCAATATGACCGCCATGTTGACATTGATTA
TTGACTAGTTATTAATAGTAATCAATTACGGGGTCATTAGTTCATAGCCCATATATGGAGTTCCGCGTTA
CATAACTTACGGTAAATGGCCCGCCTGGCTGACCGCCCAACGACCCCCGCCCATTGACGTCAATAATGAC
GTATGTTCCCATAGTAACGCCAATAGGGACTTTCCATTGACGTCAATGGGTGGAGTATTTACGGTAAACT
GCCCACTTGGCAGTACATCAAGTGTATCATATGCCAAGTCCGCCCCCTATTGACGTCAATGACGGTAAAT
GGCCCGCCTGGCATTATGCCCAGTACATGACCTTACGGGACTTTCCTACTTGGCAGTACATCTACGTATT
AGTCATCGCTATTACCATGGTGATGCGGTTTTGGCAGTACATCAATGGGCGTGGATAGCGGTTTGACTCA
CGGGGATTTCCAAGTCTCCACCCCATTGACGTCAATGGGAGTTTGTTTTGGCACCAAAATCAACGGGACT
TTCCAAAATGTCGTAACAACTCCGCCCCATTGACGCAAATGGGCGGTAGGCGTGTACGGTGGGAGGTCTA
TATAAGCAGAGCTCGTTTAGTGAACCGTCAGATCGCCTGGAGACGCCATCCACGCTGTTTTGACCTCCAT
AGAAGACACCGGGACCGATCCAGCCTCCGCGGGCGCGCGTCGACGGCGACGCGAAACTTGGGCCCACTC
GAGAAGAAAATGGCCTCCAAGTGGTCGAAGAGCTCCATCGTCGGGTGGCCGCAAGTCCGGGAGCGCATCC
GGCAGACGCCCCCCGCGGCCGAGGGGGTCGGCGCGGTCTCGCAGGACCTCGACAAGCACGGGCGGTCAC
GTCGAGCAACACCGCCGCGAACAACGCGGACTGCGCGTGGCTGCAGGCCCAGGAGGAAGAGGAAGAGGTC
GGCTTCCCGGTCAAGCCGCAAGTGCCGCTCAGGCCGATGACGTACAAGGGGGCCTTCGACCTCTCGTTCT
TCCTGAAAGAGAAGGGTGGCCTGGACGGGCTCATCTACTCGAAGAAGAGGCAGGAGATCCTCGACCTGTG
GGTCTACCACACCCAGGGGTTCTTCCCGGACTGGCACAACTACACGCCAGGCCCGGGAACCCGCTACCCG
CTGTGCTTCGGGTGGTGCTTCAAGCTCGTCCCCATGGACCCGGCCGAGGTCGAGGAAGCCACCGAGGGCG
AGAACAACTCCCTCCTGCACCCGATCTGCCAGCACGGGATGGAGGACGAGGACCGCGAGGTGCTGGTCTG
GCGGTTCGACTCGTCCCTGGCCCGGCGCCACATCGCCCGCGAGCTCCACCCGGAGTACTACAAGGACTGC
TGATAAGCTAGCGGATCCTGATCAGCCTCGACTGTGCCTTCTAGTTGCCAGCCATCTGTTGTTTGCCCCT
CCCCCGTGCCTTCCTTGACCCTGGAAGGTGCCACTCCCACTGTCCTTTCCTAATAAAATGAGGAAATTGC
ATCGCATTGTCTGAGTAGGTGTCATTCTATTCTGGGGGGTGGGGTGGGGCAGGACAGCAAGGGGGAGGAT
TGGGAAGACAATAGCAGGCATGCTGGGGAATTT
```

THURSDAY, AUGUST 2, 2007          SEQUENCE C    LENGTH : 3953
Mosaic and CON nef_Dmyr_final.doc

Fig. 22 cont'd-16

```
AATII     GACGTC              3685                      1835      1973      1976
4 SITES                      BSPHI     TCATGA          1994      2110      2250
   2510      2563      2646  2 SITES                   2279
2832                            1007      1105          2282      3129      3166
ACCI      GTMKAC             BSPNI     CCWGG           3235      3261      3306
2 SITES                      13 SITES                  3315
   3050      3433                52      1738      1751 FNUDII    CGCG
AFLIII    ACRYGT             1872      2475      2668  17 SITES
1 SITE                       2977                         494      1273      1854
   1897                         3270      3381      3444 2169      2257      2281
ALUI      AGCT               3478      3657      3801  2445
13 SITES                     BSSHII    GCGCGC             3039      3045      3047
    109       633      1340  1 SITE                     3052      3165      3183
   1597      1643      1733     3045                    3237
   1959                      BSTNI     CCWGG               3246      3255      3625
   2184      2951      3112  13 SITES                   HAEII     RGCGCY
   3524      3603      3717      52      1738      1751 4 SITES
ALWNI     CAGNNNCTG          1872      2475      2668      12      1657      2027
2 SITES                      2977                       3668
   1488      2129               3270      3381      3444 HAEIII    GGCC
AOSII     GRCGYC             3478      3657      3801  21 SITES
7 SITES                      CFR10I    RCCGGY              55       771      1176
   2507      2560      2643  1 SITE                     1423      1857      1875
   2829      2983      3156     847                     1886
   3665                      CFRI      YGGCCR             2268      2469      2662
APAI      GGGCCC             4 SITES                    3073      3093      3128
1 SITE                          769      3126      3166 3168
   3075                      3541                          3267      3323      3342
APALI     GTGCAC             CLAI      ATCGAT             3379      3461      3543
2 SITES                      1 SITE                     3660
   1583      2081               2287                   HGIAI     GWGCWC
AVAI      CYCGRG             DDEI      CTNAG           5 SITES
3 SITES                      12 SITES                      1587      2085      2951
   3078      3482      3676      12       204       397 3114      3685
BAMHI     GGATCC                711       787      1214      1623 HHAI      GCGC
1 SITE                          2088      2158      2229 17 SITES
   3723                      3318      3861                11       496      1273
BANI      GGYRCC             DPNI      GATC            1382      1556      1656
4 SITES                      13 SITES                   1723
    538      2850      3664      190       195       460    1993      2026      2169
   3807                      1239      1247      1258  2249      3045      3047
BANII     GRGCYC             1333                      3145
5 SITES                         2972      3028      3417    3183      3255      3667
   2953      3075      3114  3594      3725      3731  HINCII    GTYRAC
   3391      3685            DRAIII    CACNNNGTG       4 SITES
BBEI      GGCGCC             1 SITE                       413       886      2369
1 SITE                          1161                    3051
   3668                      ECO47I    GGWCC           HINFI     GANTC
BCLI      TCATCA             8 SITES                   14 SITES
1 SITE                          122       586       919     43        59       357
   3729                      1048      3021      3193      383       401       725       779
BCNI      CCSGG              3535                          807      1527      1923
13 SITES                        3619                      1998      2222      2795
   1173      1523      3021  ECOO109   RGGNCCY         3648
   3139      3298      3457  2 SITES                   HINPI     GCGC
   3484                         3194      3340         17 SITES
   3485      3541      3663  ECORII    CCWGG                9       494      1271
   3678      3679      3691  13 SITES                   1380      1554      1654
BGLI      GCCNNNNNGGC            50      1736      1749 1721
4 SITES                      1870      2473      2666      1991      2024      2167
   2475      2597      2668  2975                       2247      3043      3045
   3320                         3268      3379      3442 3143
BGLII     AGATCT             3476      3655      3799     3181      3253      3665
1 SITE                       ECORV     GATATC          HPAII     CCGG
    458                      1 SITE                    16 SITES
BSP1286   GDGCHC                2294                       848      1172      1329
8 SITES                      FNU4HI    GCNGC           3019
    652      1587      2085  21 SITES                      3137      3149      3297
   2953      3075      3114      234       769      1283    3456      3483      3540
   3391                      1489      1492      1557  3662
                             1700
Mosaic and CON nef_Dmyr_final.doc
```

Fig. 22 cont'd-17

```
    3677    3690              1 SITE                     652    1587    2085
MAEI      CTAG                  796                     2953    3075    3314
7 SITES                   NSP7524I  RCATGY              3391
     378     801    1034  2 SITES                       3585
    1404    2385    3718       1901    3942             SINI      GGWCC
    3751                  NSPBII    CMGCKG              8 SITES
MAEII     ACGT            6 SITES                            123     587     920
12 SITES                       1314    1559    2281         1049    3022    3194
     669    1160    1196      3039    3165    3500         3536
    2306    2507    2519  PPUMI     RGGWCCY                3620
    2560                  1 SITE                        SMAI      CCCGGG
    2643    2724    2829       3194                    2 SITES
    3219    3230          PSSI      RGGNCCY                 3484    3676
MAEIII    GTNAC           2 SITES                       SNABI     TACGTA
9 SITES                        3197    3343             1 SITE
     270    1134    1361  PSTI      CTGCAG                  2725
    1477    1540    2446  1 SITE                        SPEI      ACTAGT
    2533                       3265                     1 SITE
    2882    3215          RSAI      GTAC                     2334
MVAI      CCNGG           11 SITES                      SPHI      GCATGC
26 SITES                       589    2093    2263     1 SITE
      52    1172    1520      2330    2604    2684         3942
    1738    1751    1872      2717                      SSPI      AATATT
    2475                       2768    2925    3333     2 SITES
    2668    2977    3020      3696                           603     991
    3138    3270    3297  SACI      GAGCTC              STUI      AGGCCT
    3381                  3 SITES                       1 SITE
    3444    3456    3478       2953    3114    3685         55
    3483    3484    3540  SACII     CCGCGG              STYI      CCWWGG
    3657                  3 SITES                       2 SITES
    3662    3677    3678       2282    3040    3166         2745    3532
    3690    3801          SALI      GTCGAC              TAQI      TCGA
NARI      GGCGCC          1 SITE                        14 SITES
1 SITE                         3049                          216    1795    2287
    3665                  SAU3A     GATC                    3050    3079    3105
NCII      CCSGG           13 SITES                          3199
13 SITES                       188     193     458         3222    3346    3399
    1172    1520    3020      1237    1245    1256         3421    3550    3646
    3138    3297    3456      1331                         3738
    3483                       2970    3026    3415    XHOI      CTCGAG
    3484    3540    3662      3592    3723    3725     1 SITE
    3677    3678    3690  SAU96A    GGNCC                   3678
NCOI      CCATGG          18 SITES                      XHOII     RGATCY
2 SITES                        123     587     920     5 SITES
    2745    3532              1049    1174    2266          458    1245    1256
NDEI      CATATG              2468                         3415    3723
2 SITES                        2661    3022    3071    XMAI      CCCGGG
    2076    2619              3072    3194    3266     2 SITES
NHEI      GCTAGC              3340                          3482    3676
1 SITE                         3480    3536    3620    XMAIII    CGGCCG
    3717                      3659                      2 SITES
NLAIII    CATG            SCAI      AGTACT                  3156    3541
15 SITES                  1 SITE                        XMNI      GAANNNNTTC
     538     762     864      3696                      1 SITE
     892    1011    1109    1181  SCRFI    CCNGG            811
    1901    2219    2349  26 SITES
    2367    2689    2749        52    1172    1520     FOLLOWING ENZYMES HAVE NO
    3536                      1738    1751    1872     SITES
    3942                      2475                     ACCIII    AFLII    ASP718
NLAIV     GGNNCC              2668    2977    3020     ASUII     AVRII    BALI
13 SITES                      3138    3270    3297     BSPMII    BSTEII   BSTXI
      92     540    1830      3381                     DRAI      ECO47III FCORI
    1865    2952    3023      3444    3456    3476     ESPI      FSPI     HINDIII
    3073                      3483    3484    3540     HPAI      KPNI     MLUI
    3341    3488    3538      3657                     MSTI      NAEI     NOTI
    3666    3725    3809      3662    3677    3678     OXANI     PFLMI    PVUI
NRUI      TCGCGA              3690    3801             PVUII     RSRII    SFII
1 SITE                    SDNI      GDGCHC             SPLI      TTH111I  XBAI
    2257                  6 SITES                      XCAI
NSII      ATGCAT

Mosaic and CON nef_Dmyr_final.doc
```

Fig. 22 cont'd-18

Gag gene constructs:

| HVI number | Gene name | Gag | Myristylation signal mutated |
|---|---|---|---|
| HV13234 | M.con_Gag01_Dmyr.wlv | Group M (2001) | Yes |
| HV13309 | Gag-M4.1_Dmyr.wlv | Mosaic No. 1 | Yes |
| HV13316 | Gag_M4.2_Dmyr.wlv | Mosaic No. 2 | Yes |
| HV13317 | Gag_M4.3_Dmyr.wlv | Mosaic No. 3 | Yes |
| HV13318 | Gag_M4.4_Dmyr.wlv | Mosaic No. 4 | Yes |

All five constructs were cloned into HV10001 (WLV001AM DNA vaccine plasmid.

M.con_Gag01_Dmyr
MAARASVLSGGKLDAWEKIRLRPGGKKKYRLKHLVWASRELERFALNPGLLETSEGCQQIIGQLQPALQT
GSEELRSLYNTVATLYCVHQRIEVKDTKEALEKIEEEQNKSQQKTQQAAADKGNSSKVSQNYPIVQNLQG
QMVHQAISPRTLNAWVKVIEEKAFSPEVIPMFSALSEGATPQDLNTMLNTVGGHQAAMQMLKDTINEEAA
EWDRLHPVHAGPIPPGQMREPRGSDIAGTTSTLQEQIAWMTSNPPIPVGEIYKRWIILGLNKIVRMYSPV
SILDIRQGPKEPFRDYVDRFFKTLRAEQATQDVKNWMTDTLLVQNANPDCKTILKALGPGATLEEMMTAC
QGVGGPSHKARVLAEAMSQVTNAAIMMQRGNFKGQRRIIKCFNCGKEGHIARNCRAPRKKGCWKCGKEGH
QMKDCTERQANFLGKIWPSNKGRPGNFLQSRPEPTAPPAESFGFGEEITPSPKQEPKDKEPPLASLKSLF
GNDPLSQ_

HV13234 (M.con_Gag01_Dmyr.wlv) (1527nt)
XhoI
CTCGAGAAGAAAATGGCGGCTCGCGCCTCGGTCCTCAGCGGGGGCAAGTTGGATGCGTGGGAGAA
GATCCGCTTGAGGCCAGGAGGGAAGAAGAAGTACCGGCTCAAGCACCTGGTCTGGGCGAGCAGG
GAGCTGGAGCGCTTCGCGCTGAACCCGGGCCTGCTGGAGACATCCGAGGGCTGTCAGCAGATCA
TCGGGCAGCTTCAGCCAGCGCTCCAGACGGGCAGCGAGGAGCTGCGCTCGCTATACAACACGGT
AGCGACCCTCTACTGCGTGCACCAGCGGATCGAGGTCAAGGACACGAAGGAGGCTCTTGAGAAG
ATCGAGGAGGAGCAGAACAAGTCGCAGCAGAAGACCCAGCAGGCGGCGGCCGACAAGGGCAACT
CCTCAAAAGTATCTCAGAACTACCCGATCGTGCAGAACCTGCAGGGACAGATGGTCCACCAGGC
CATCAGCCCACGGACGCTTAACGCCTGGGTCAAGGTGATCGAGGAGAAGGCCTTCTCGCCGGAG
GTCATCCCCATGTTCTCGGCACTCTCCGAGGGAGCCACCCCGCAGGACCTGAACACGATGTTGA
ACACGGTCGGCGGGCACCAGGCGGCCATGCAGATGCTCAAGGATACCATCAACGAGGAGGCTGC
GGAGTGGGACCGCCTGCACCCAGTGCACGCGGGGCCCATCCCCCCGGGCCAGATGAGAGAGCCG
CGGGGATCGGACATCGCGGGCACGACCAGCACCTTGCAGGAGCAAATCGCCTGGATGACTAGCA
ACCCCCCGATCCCGGTCGGGGAGATCTACAAGCGGTGGATCATCCTCGGGTTGAACAAGATCGT
GCGGATGTACAGCCCTGTCTCAATCCTGGACATCCGGCAGGGGCCCAAGGAGCCCTTCCGCGAC
TACGTCGACCGGTTCTTCAAGACTCTCCGGGCGGAGCAGGCGACGCAGGACGTCAAGAACTGGA
TGACGGACACCTTGTTGGTCCAGAACGCTAACCCGGACTGCAAGACGATCCTGAAGGCTCTCGG
CCCGGGAGCGACCTTGGAGGAGATGATGACCGCGTGCCAGGGGGTCGGGGGACCCAGCCACAAG
GCGCGGGTCTTGGCCGAGGCGATGTCCCAGGTCACGAACGCCGCGATCATGATGCAGCGGGGA
ACTTCAAGGGCCAGCGCCGGATCATCAAGTGCTTCAACTGCGGCAAGGAGGGCCACATCGCCCG
GAACTGCCGGGCCCCGCGGAAGAAGGGCTGCTGGAAGTGCGGAAAGGAGGGGCACCAGATGAAG
GACTGCACGGAGCGCCAGGCGAATTTCCTCGGGAAGATCTGGCCGTCCAACAAGGGGCGGCCAG
GGAACTTCCTGCAATCGCGGCCAGAGCCGACGGCCCCTCCCGCGGAGAGCTTCGGGTTCGGCGA

Fig. 22 cont'd-19

```
GGAGATCACGCCCAGCCCCAAGCAAGAGCCGAAGGACAAGGAGCCGCCCCTTGCGTCCCTCAAG
TCGCTCTTCGGCAACGACCCGCTCTCCCAATGATAAGCTAGCGGATCCTGATCA
                                 NheI    BamHI   BclI
```
Cut with XhoI and NheI site for VSV subcloning.
>HV13234 in hv10001 (4,822bp)
AAATGGGGGCGCTGAGGTCTGCCTCGTGAAGAAGGTGTTGCTGACTCATACCAGGCCTGAATCGCCCCAT
CATCCAGCCAGAAAGTGAGGGAGCCACGGTTGATGAGAGCTTTGTTGTAGGTGGACCAGTTGGTGATTTT
GAACTTTTGCTTTGCCACGGAACGGTCTGCGTTGTCGGGAAGATGCGTGATCTGATCCTTCAACTCAGCA
AAAGTTCGATTTATTCAACAAAGCCGCCGTCCCGTCAAGTCAGCGTAATGCTCTGCCAGTGTTACAACCA
ATTAACCAATTCTGCGTTCAAAATGGTATGCGTTTTGACACATCCACTATATATCCGTGTCGTTCTGTCC
ACTCCTGAATCCCATTCCAGAAATTCTCTAGCGATTCCAGAAGTTTCTCAGAGTCGGAAAGTTGACCAGA
CATTACGAACTGGCACAGATGGTCATAACCTGAAGGAAGATCTGATTGCTTAACTGCTTCAGTTAAGACC
GACGCGCTCGTCGTATAACAGATGCGATGATGCAGACCAATCAACATGGCACCTGCCATTGCTACCTGTA
CAGTCAAGGATGGTAGAAATGTTGTCGGTCCTTGCACACGAATATTACGCCATTTGCCTGCATATTCAAA
CAGCTCTTCTACGATAAGGGCACAAATCGCATCGTGGAACGTTTGGGCTTCTACCGATTTAGCAGTTTGA
TACACTTTCTCTAAGTATCCACCTGAATCATAAATCGGCAAAATAGAGAAAAATTGACCATGTGTAAGCG
GCCAATCTGATTCCACCTGAGATGCATAATCTAGTAGAATCTCTTCGCTATCAAAATTCACTTCCACCTT
CCACTCACCGGTTGTCCATTCATGGCTGAACTCTGCTTCCTCTGTTGACATGACACACATCATCTCAATA
TCCGAATACGGACCATCAGTCTGACGACCAAGAGAGCCATAAACACCAATAGCCTTAACATCATCCCCAT
ATTTATCCAATATTCGTTCCTTAATTTCATGAACAATCTTCATTCTTTCTTCTCTAGTCATTATTATTGG
TCCGTTCATAACACCCCTTGTATTACTGTTTATGTAAGCAGACAGTTTTATTGTTCATGATGATATATTT
TTATCTTGTGCAATGTAACATCAGAGATTTTGAGACACAACGTGGCTTTCCCCGGCCCATGACCAAAATC
CCTTAACGTGAGTTTTCGTTCCACTGAGCGTCAGACCCCGTAGAAAAGATCAAAGGATCTTCTTGAGATC
CTTTTTTTCTGCGCGTAATCTGCTGCTTGCAAACAAAAAAACCACCGCTACCAGCGGTGGTTTGTTTGCC
GGATCAAGAGCTACCAACTCTTTTTCCGAAGGTAACTGGCTTCAGCAGAGCGCAGATACCAAATACTGTT
CTTCTAGTGTAGCCGTAGTTAGGCCACCACTTCAAGAACTCTGTAGCACCGCCTACATACCTCGCTCTGC
TAATCCTGTTACCAGTGGCTGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACAGCCCAGCTTGGAGCGAACG
ACCTACACCGAACTGAGATACCTACAGCGTGAGCTATGAGAAAGCGCCACGCTTCCCGAAGGGAGAAAGG
CGGACAGGTATCCGGTAAGCGGCAGGGTCGGAACAGGAGAGCGCACGAGGGAGCTTCCAGGGGGAAACGC
CTGGTATCTTTATAGTCCTGTCGGGTTTCGCCACCTCTGACTTGAGCGTCGATTTTTGTGATGCTCGTCA
GGGGGGCGGAGCCTATGGAAAAACGCCAGCAACGCGGCCTTTTTACGGTTCCTGGCCTTTTGCTGGCCTT
TTGCTCACATGTTCTTTCCTGCGTTATCCCCTGATTCTGTGGATAACCGTATTACCGCCTTTGAGTGAGC
TGATACCGCTCGCCGCAGCCGAACGACCGAGCGCAGCGAGTCAGTGAGCGAGGAAGCGGAAGAGCGCCTG
ATGCGGTATTTTCTCCTTACGCATCTGTGCGGTATTTCACACCGCATATGGTGCACTCTCAGTACAATCT
GCTCTGATGCCGCATAGTTAAGCCAGTATCTGCTCCCTGCTTGTGTGTTGGAGGTCGCTGAGTAGTGCGC
GAGCAAAATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCATACGTT
GTATCTATATCATAATATGTACATTTATATTGGCTCATGTCCAATATGACCGCCATGTTGACATTGATTA
TTGACTAGTTATTAATAGTAATCAATTACGGGGTCATTAGTTCATAGCCCATATATGGAGTTCCGCGTTA
CATAACTTACGGTAAATGGCCCGCCTGGCTGACCGCCCAACGACCCCCGCCCATTGACGTCAATAATGAC
GTATGTTCCCATAGTAACGCCAATAGGGACTTTCCATTGACGTCAATGGGTGGAGTATTTACGGTAAACT
GCCCACTTGGCAGTACATCAAGTGTATCATATGCCAAGTCCGCCCCCTATTGACGTCAATGACGGTAAAT
GGCCCGCCTGGCATTATGCCCAGTACATGACCTTACGGGACTTTCCTACTTGGCAGTACATCTACGTATT
AGTCATCGCTATTACCATGGTGATGCGGTTTTGGCAGTACATCAATGGGCGTGGATAGCGGTTTGACTCA
CGGGGATTTCCAAGTCTCCACCCCATTGACGTCAATGGGAGTTTGTTTTGGCACCAAAATCAACGGGACT
TTCCAAAATGTCGTAACAACTCCGCCCCATTGACGCAAATGGGCGGTAGGCGTGTACGGTGGGAGGTCTA
TATAAGCAGAGCTCGTTTAGTGAACCGTCAGATCGCCTGGAGACGCCATCCACGCTGTTTTGACCTCCAT
AGAAGACACCGGGACCGATCCAGCCTCCGCGGGCGCGCGTCGACGGGCGACGCGAAACTTGGCCCACTC
GAGAAGAAAATGGCGGCTCGCGCCTCGGTCCTCAGCGGGGGCAAGTTGGATGCGTGGGAGAAGATCCGCT
TGAGGCCAGGAGGGAAGAAGAAGTACCGGCTCAAGCACCTGGTCTGGGCGAGCAGGGAGCTGGAGCGCTT
CGCGCTGAACCCGGGCCTGCTGGAGACATCCGAGGGCTGTCAGCAGATCATCGGGCAGCTTCAGCCAGCG
CTCCAGACGGGCAGCGAGGAGCTGCGCTCGCTATACAACACGGTAGCGACCCTCTACTGCGTGCACCAGC

Fig. 22 cont'd-20

```
GGATCGAGGTCAAGGACACGAAGGAGGCTCTTGAGAAGATCGACGAGGAGCAGAACAAGTCGCAGCAGAA
GACCCAGCAGGCGGCGGCCGACAAGGGCAACTCCTCAAAAGTATCTCAGAACTACCCGATCGTGCAGAAC
CTGCAGGGACAGATGGTCCACCAGGCCATCAGCCCACGGACGCTTAACGCCTGGGTCAAGGTGATCGAGG
AGAAGGCCTTCTCGCCGGAGGTCATCCCCATGTTCTCGGCACTCTCCGAGGGAGCCACCCCGCAGGACCT
GAACACGATGTTGAACACGGTCGGCGGGCACCAGGCGGCCATGCAGATGCTCAAGGATACCATCAACGAG
GAGGCTGCGGAGTGGGACCGCCTGCACCCAGTGCACGCGGGGCCCATCCCCTCGGGCCAGATGAGAGAGC
CGCGGGGATCGGACATCGCGGGCACGACCAGCACCTTGCAGGAGCAAATCGCCTGGATGACTAGCAACCC
CCCGATCCCGGTCGGGGAGATCTACAAGCGGTGGATCATCCTCGGGTTGAACAAGATCGTGCGCATGTAC
AGCCCTGTCTCAATCCTGGACATCCGGCAGGGGCCCAAGGAGCCCTTCCGCGACTACGTCGACCGGTTCT
TCAAGACTCTCCGGCGGAGCAGGCGACGCAGGACGTCAAGAACTGGATGACGGACACCTTGTTGGTCCA
GAACGCTAACCCGGACTGCAAGACGATCCTGAAGGCTCTCGGCCCGGGAGCGACCTTGGAGGAGATGATG
ACCGCGTGCCAGGGGGTCGGGGGACCCAGCCACAAGGCGCGGGTCTTGGCCGAGGCGATGTCCAGGTCA
CGAACGCCGCGATCATGATGCAGCGGGGGAACTTCAAGGGCCAGCGCCGGATCATCAAGTGCTTCAACTG
CGGCAAGGAGGGCCACATCGCCCGGAACTGCCGGGCCCCGCGGAAGAAGGGCTGCTGGAAGTGCGGAAAG
GAGGGGCACCAGATGAAGGACTGCACGGAGCGCCAGGCGAATTTCCTCGGGAAGATCTGGCCGTCCAACA
AGGGGCGGCCAGGGAACTTCCTGCAATCGCGGCCAGAGCCGACGGCCCCTCCCGCGGAGAGCTTCGGGTT
CGGCGAGGAGATCACGCCCAGCCCCAAGCAAGAGCCGAAGGACAAGGAGCCGCCCCTTGCGTCCCTCAAG
TCGCTCTTCGGCAACGACCCGCTCTCCCAATGATAAGCTAGCGGATCCTGATCAGCCTCGACTGTGCCTT
CTAGTTGCCAGCCATCTGTTGTTTGCCCCTCCCCCGTGCCTTCCTTGACCCTGGAAGGTGCCACTCCCAC
TGTCCTTTCCTAATAAAATGAGGAAATTGCATCGCATTGTCTGAGTAGGTGTCATTCTATTCTGGGGGGT
GGGGTGGGCAGGACAGCAAGGGGGAGGATTGGGAAGACAATAGCAGGCATGCTGGGGAATTT
```

```
Thursday, August 2, 2007        BanI     GGYRCC              4140   4194   4374
                                5 Sites                      4420   4671
Sequence D   Length : 4823        538   2850   3667          BssHII   GCGCGC
                                 4345   4677                 1 Site
AatII     GACGTC                BanII    GRGCYC               3045
5 Sites                         6 Sites                      BstNI    CCWGG
 2510   2563   2646              2953   3075   3754          19 Sites
 2832   4027                     3955   3964   4307            52   1738   1751
AccI      GTMKAC                BclI     TGATCA              1872   2475   2668
2 Sites                         1 Site                       2977
 3050   3979                     4599                        3157   3189   3522
AflIII    ACRYGT                BcnI     CCSGG               3551   3672   3833
1 Site                          14 Sites                     3936
 1897                            1173   1521   3021          4140   4194   4374
AluI      AGCT                   3232   3233   3763          4420   4671
14 Sites                         3764                        Cfr10I   RCCGGY
  109    633   1340              3859   4003   4072          3 Sites
 1597   1643   1733              4105   4106   4293            847   3175   3982
 1959                            4303                        CfrI     YGGCCR
 2184   2951   3209             BglI     GCCNNNNNGGC         7 Sites
 3278   3311   4471             3 Sites                        769   3445   3676
 4587                            2475   2597   2668          4177   4398   4416
AlwNI     CAGNNNCTG             BglII    AGATCT              4440
4 Sites                         3 Sites                      ClaI     ATCGAT
 1488   2129   3500               458   3868   4393          1 Site
 3638                           Bsp1286  GDGCHC               2287
AosII     GRCGYC                14 Sites                     DdeI     CTNAG
6 Sites                           652   1587   2085          13 Sites
 2507   2560   2643              2953   3075   3355            12    204    397
 2829   2983   4024              3670                          711    787   1214   1523
ApaI      GGGCCC                 3745   3754   3804          2088   2156   2229
4 Sites                          3955   3964   4307          3111   3475   4731
 3075   3754   3955              4343                        DpnI     GATC
 4307                           BspHI    TCATGA              27 Sites
ApaLI     GTGCAC                3 Sites                        190    195    460
4 Sites                          1007   1105   4213          1239   1247   1258
 1583   2081   3351             BspKI    CCWGG               1333
 3741                           19 Sites                     2972   3028   3144
AvaI      CYCGRG                   52   1738   1751          3267   3363   3399
6 Sites                         1872   2475   2668           3489
 3078   3230   3761             2977                         3564   3788   3855
 3891   4103   4386             3157   3189   3522           3870   3883   3906
BamHI     GGATCC                3551   3672   3833           4086
1 Site                          3936                         4212   4251   4395
 4593                                                        4491   4595   4601
Mosaic and Group M Gag_dmyr-patent.doc
```

Fig. 22 cont'd-21

```
DraIII    CACNNNGTG              4179    4240    4282           52    1172    1520
2 Sites                   4305    4400    4418          1738    1751    1872
    1161    3740          4442                          2475
Eco47I    GGWCC           4455                              2668    2977    3020
11 Sites                  HgiAI    GWGCWC              3157    3189    3231
     122     586     929  5 Sites                      3232
    1048    3021    3106      1587    2085    2953         3522    3551    3672
    3514                      3355    3745              3762    3763    3833
    3634    3724    4054  HhaI     GCGC                3858
    4151                  21 Sites                         3936    4002    4071
Eco47III  AGCGCT              11     496    1273          4104    4105    4140
2 Sites                      1382    1556    1656          4194
    3216    3289             1723                          4292    4302    4374
EcoO109   RGGNCCY             1993    2026    2169          4420    4671
5 Sites                      2249    3045    3047      NciI     CCSGG
    3635    3750    3951     3102                      14 Sites
    4152    4304              3217    3224    3290         1172    1520    3020
EcoRII    CCWGG               3316    4169    4246         3231    3232    3762
19 Sites                     4372                          3763
      50    1736    1749  HincII   GTYRAC                  3858    4002    4071
    1870    2473    2666  5 Sites                          4104    4105    4292
    2975                       413     886    2369         4302
    3155    3187    3520      3051    3980             NcoI     CCATGG
    3549    3670    3831  HinfI    GANTC                1 Site
    3934                  14 Sites                          2745
    4138    4192    4372        43      59     357     NdeI     CATATG
    4418    4669              383     401     725     779   2 Sites
EcoRV     GATATC              807    1527    1923           2076    2619
1 Site                       1998    2222    2795      NheI     GCTAGC
    2294                     3995                      1 Site
Fnu4HI    GCNGC           HinPI    GCGC                    4587
32 Sites                  21 Sites                     NlaIII   CATG
     234     769    1283        9     494    1271     17 Sites
    1489    1492    1557     1380    1554    1654          538     762     864
    1700                     1721                           892    1011    1109    1181
    1855    1973    1976     1991    2024    2167         1901    2219    2349
    1994    2110    2250     2247    3043    3045         2357    2689    2749
    2279                     3100                          3602
    2282    3094    3276     3215    3222    3288         3693    4217    4812
    3302    3312    3423     3314    4167    4244     NlaIV    GGNNCC
    3442                     4370                      24 Sites
    3445    3676    3715  HpaII    CCGG                      92     540    1830
    3780    4207    4221  20 Sites                         1869    2852    3023
    4271                      848    1172    1329         3073
    4322    4416    4440     1519    1545    1692         3623    3669    3726
    4530                     3019                          3751    3752    3952
FnuDII    CGCG                3176    3231    3585         3953
23 Sites                     3762    3858    3944         3961    4153    4154
     494    1273    1854     3983                          4305    4300    4347
    2169    2257    2281     4001    4071    4104         4456
    2445                     4247    4292    4300         4528    4595    4679
    3039    3045    3047  MaeI     CTAG                NruI     TCGCGA
    3062    3100    3222  8 Sites                      1 Site
    3747                       373     801    1034         2257
    3782    3798    3970     1404    2385    3841     NsiI     ATGCAT
    4134    4169    4209     4588                      1 Site
    4310                     4621                           796
    4439    4464          MaeII    ACGT                Nsp7524I RCATGY
HaeII     RGCGCY          12 Sites                     2 Sites
7 Sites                       669    1160    1196          1801    4812
      12    1657    2027     2306    2507    2519     NspBII   CMGCKG
    3218    3291    4247     2560                      10 Sites
    4373                     2643    2724    2829          1314    1559    2281
HaeIII    GGCC               3976    4024                  3039    3115    3359
29 Sites                  MaeIII   GTNAC                   3782
      65     771    1175  9 Sites                          4223    4310    4464
    1423    1857    1875      270    1134    1361     PpuMI    RGGWCCY
    1886                     1477    1640    2443      2 Sites
    2268    2469    2662     2533                          3635    4152
    3073    3155    3235     2882    4195             PssI     RGGNCCY
    3447                  MvaI     CCNGG               5 Sites
    3525    3576    3678  33 Sites                         3638    3753    3954
    3752    3766    3953                                   4155    4307
    4102                                               PstI     CTGCAG
Mosaic and Group M Gag_dmyr-patent.doc
```

Fig. 22 cont'd-22

```
1 Site                    2668    2977    3020        3975
    3505                  3157    3189    3231     XhoI        CTCGAG
PvuI       CGATCG         3232                     1 Site
1 Site                        3522    3551    3672       3078
    3490                  3762    3763    3833     XhoII       RGATCY
RsaI       GTAC           3858                     7 Sites
11 Sites                      3936    4002    4071        458    1245    1256
     559    2093    2263  4104    4105    4140     3142    3868    4393
2330    2604    2684      4194                     4593
2717                          4292    4302    4374  XmaI       CCCGGG
    2769    2925    3174  4420    4671             3 Sites
3918                      SdnI       GDGCHC            3230    3761    4103
SacI       GAGCTC         14 Sites                 XmaIII      CGGCCG
1 Site                        652    1587    2085  1 Site
    2953                  2953    3075    3355         3445
SacII      CCGCGG         3670                     XmnI        GAANNNNTTC
5 Sites                       3745    3754    3804  2 Sites
    2282    3040    3783  3955    3964    4307         811    3576
4311    4465              4348
SalI       GTCGAC         SinI       GGWCC         Following enzymes have no
2 Sites                   11 Sites                 sites
    3049    3978              123     587     920  AccIII    AflII     Asp718
Sau3A      GATC           1049    3022    3107     AsuII     AvrII     BalI
27 Sites                  3515                     BbeI      BspMII    BstEII
    138     193     458       3635    3725    4055  BstXI     DraI     EcoRI
1237    1245    1256      4152                     EspI      FspI      HindIII
1531                      SmaI       CCCGGG        HpaI      KpnI      MluI
    2970    3026    3142  3 Sites                  MstI      NaeI      NarI
3265    3361    3397          3232    3763    4105  NotI      OxaNI     PflMI
3487                      SnaBI      TACGTA        PvuI      RsrII     ScaI
    3552    3786    3853  1 Site                   SfiI      SplI      XbaI
3868    3883    3904          2725                 XcaI
4084                      SpeI       ACTAGT
    4210    4249    4393  1 Site                   1 Site
4489    4593    4599          2384                     2953
Sau96A     GGNCC          SphI       GCATGC        SnaBI       TACGTA
29 Sites                  1 Site                   1 Site
    123     587     920       4812                     2725
1049    1174    2266      SspI       AATATT        SpeI        ACTAGT
2468                      2 Sites                  1 Site
    2661    3022    3071      603     991              2384
3072    3107    3233      StuI       AGGCCT        SphI        GCATGC
3515                      2 Sites                  1 Site
    3635    3725    3750       55    3576              4812
3751    2764    3951      StyI       CCWWGG        Tth111I     GACNNNGTC
3952                      3 Sites                  1 Site
    4055    4101    4152      2745    3955    4114     3975
4238    4280    4303      TaqI       TCGA          XhoI        CTCGAG
4304                      10 Sites                 1 Site
4454                          216    1799    2287      3078
ScrFI      CCNGG          3050    3079    3364     XmaIII      CGGCCG
33 Sites                  3400                     1 Site
    52      1172    1520      3565    3979    4608     3445
1738    1751    1872      Tth111I    GACNNNGTC
2475                      1 Site
```

Gag-M4.1Dmyr

MAARASVLSGGELDRWEKIRLRPGGKKKYKLKHIVWASRELERFAVNPGLLETSEGCRQILGQL
QPSLQTGSEELRSLYNTVAVLYCVHQRIDVKDTKEALEKIEEEQNKSQQKTQQAKAADGKVSQN
YPIVQNAQGQMVHQAISPRTLNAWVKVIEEKGFSPEVIPMFSALAEGATPQDLNTMLNTIGGHQ
AAMQMLKDTINDEAAEWDRLHPVQAGPVAPGQIREPRGSDIAGTTSNLQEQIGWMTSNPPIPVG
DIYKRWIIMGLNKIVRMYSPTSILDIRQGPKESFRDYVDRFFRTLRAEQASQEVKNWMTETLLV
QNSNPDCKTILKALGPAATLEEMMTACQGVGGPGHKARVLAEAMSQVQQPNIMMQRGNFKGQKR
IKCFNCGREGHLARNCRAPRKKGCWKCGREGHQMKDCTESKANFLGKIWPSNKGRPGNFLQSRP
EPSAPPAESFGFGEEITPSQKQEQKDKELYPLASLKSLFGNDPLSQ

Mosaic and Group M Gag_dmyr-patent.doc

Fig. 22 cont'd-23

HV13309 (Gag-M4.1Dmyr.wlv)
CTCGACAAGAAAATGGCGGCGCGCGCCTCGGTCCTTAGCGGGGGCGAGTTGGATCGGTG
GGAAAAGATCCGCTTGAGGCCAGGAGGGAAGAAGAAGTACAAGCTCAAGCACATCGTCT
GGGCGAGCAGAGAGCTCGAGCGGTTCGCGGTCAACCCGGGCCTGCTTGAGACATCGGAG
GGCTGTCGGCAAATCCTGGGGCAGCTTCAACCGTCCTTGCAAACGGGCAGCGAGGAGCT
GCGATCGCTATACAACACGGTAGCGGTCCTCTACTGCGTGCACCAGCGGATCGACGTCA
AGGACACGAAGGAGGCTCTTGAGAAGATTGAGGAAGAGCAGAACAAGTCGCAGCAGAAG
ACGCAGCAGGCGAAGGCCGCAGACGGCAAAGTATCTCAGAACTACCCGATCGTGCAGAA
CGCGCAGGGACAGATGGTCCACCAGGCCATCTCCCCACGGACGCTTAACGCCTGGGTCA
AAGTAATCGAGGAGAAGGGATTCAGCCCGGAAGTGATCCCCATGTTCTCGGCACTTGCG
GAGGGAGCCACCCCGCAGGACCTGAACACGATGTTGAACACCATCGGCGGGCACCAGGC
GGCCATGCAGATGCTTAAGGACACCATCAACGACGAGGCTGCGGAGTGGGACCGGCTTC
ACCCGGTGCAGGCGGGGCCCGTCGCGCCGGGCCAGATCAGAGAGCCGCGGGCATCGGAC
ATCGCGGGAACCACCAGCAACTTGCAGGAGCAAATCGGGTGGATGACTTCGAACCCCCC
GATCCCGGTCGGGGACATCTACAAGAGATGGATCATCATGGGGTTGAACAAGATCGTGA
GGATGTACAGCCCGACCAGCATCCTGGACATCCGACAGGGACCGAAGGAGTCGTTCAGA
GACTACGTAGACCGGTTCTTCCGGACTCTCCGGGCGGAGCAGGCGTCGCAGGAGGTCAA
GAACTGGATGACGGAGACCTTGTTGGTCCAGAACTCGAACCCGGACTGCAAGACCATCC
TGAAGGCTCTCGGCCCGGCGGCGACGTTGGAAGAGATGATGACGGCGTGCCAGGGAGTC
GGGGGACCCGGCCACAAGGCGCGGGTCTTGGCCGAGGCGATGAGCCAGGTGCAGCAGCC
GAACATCATGATGCAGCGGGGCAACTTCAAGGGACAGAAGCGGATCAAGTGTTTCAACT
GTGGCAGGGAGGGACACCTCGCCAGGAACTGCCGGGCCCCGCGGAAGAAGGGCTGCTGG
AAGTGCGGAAGGGAGGGGCACCAAATGAAGGACTGCACGGAGTCGAAGGCGAATTTCCT
CGGGAAGATCTGGCCGTCCAACAAGGGCGGCCAGGGAACTTTCTGCAAAGCCGGCCGG
AGCCGTCGGCCCCGCCGGCGGAGTCCTTTGGGTTCGGGGAGGAGATCACGCCCTCGCAG
AAGCAAGAGCAAAAGGACAAGGAGCTCTACCCTCTTGCGTCCCTCAAGTCGCTCTTCGGC
AACGACCCGCTTTCGCAATGATAAGCTAGCGGATCCTGATCAGGCGCGCC
                     NheI          AscI HV13309 in HV10001, 4836bp
AAATGGGGGCGCTGAGGTCTGCCTCGTGAAGAAGGTGTTGCTGACTCATACCAGGCCTGAATCG
CCCCATCATCCAGCCAGAAAGTGAGGGAGCCACGGTTGATGAGAGCTTTGTTGTAGGTGGACCA
GTTGGTGATTTTGAACTTTTGCTTTGCCACGGAACGGTCTGCGTTGTCGGGAAGATGCGTGATC
TGATCCTTCAACTCAGCAAAAGTTCGATTTATTCAACAAAGCCGCCGTCCCGTCAAGTCAGCGT
AATGCTCTGCCAGTGTTACAACCAATTAACCAATTCTGCGTTCAAAATGGTATGCGTTTTGACA
CATCCACTATATATCCGTGTCGTTCTGTCCACTCCTGAATCCCATTCCAGAAATTCTCTAGCGA
TTCCAGAAGTTTCTCAGAGTCGGAAAGTTGACCAGACATTACGAACTGGCACAGATGGTCATAA
CCTGAAGGAAGATCTGATTGCTTAACTGCTTCAGTTAAGACCGACGCGCTCGTCGTATAACAGA
TGCGATGATGCAGACCAATCAACATGGCACCTGCCATTGCTACCTGTACAGTCAAGGATGGTAG
AAATGTTGTCGGTCCTTGCACACGAATATTACGCCATTTGCCTGCATATTCAAACAGCTCTTCT
ACGATAAGGGCACAAATCGCATCGTGGAACGTTTGGGCTTCTACCGATTTAGCAGTTTGATACA
CTTTCTCTAAGTATCCACCTGAATCATAAATCGGCAAAATAGAGAAAATTGACCATGTGTAAG
CGGCCAATCTGATTCCACCTGAGATGCATAATCTAGTAGAATCTCTTCGCTATCAAAATTCACT
TCCACCTTCCACTCACCGGTTGTCCATTCATGGCTGAACTCTGCTTCCTCTGTTGACATGACAC
ACATCATCTCAATATCCGAATACGGACCATCAGTCTGACGACCAAGAGAGCCATAAACACCAT
AGCCTTAACATCATCCCCATATTTATCCAATATTCGTTCCTTAATTTCATGAACAATCTTCATT
CTTCTTCTCTAGTCATTATTATTGGTCCGTTCATAACACCCCTTGTATTACTGTTTATGTAAG Mosaic and Group M Gag_dmyr-patent.doc     6

Fig. 22 cont'd-24

```
CAGACAGTTTTATTGTTCATGATGATATATTTTTATCTTGTGCAATGTAACATCAGAGATTTTG
AGACACAACGTGGCTTTCCCCGGCCCATGACCAAAATCCCTTAACGTGAGTTTTCGTTCCACTG
AGCGTCAGACCCCGTAGAAAAGATCAAAGGATCTTCTTGAGATCCTTTTTTTCTGCGCGTAATC
TGCTGCTTGCAAACAAAAAAACCACCGCTACCAGCGGTGGTTTGTTTGCCGGATCAAGAGCTAC
CAACTCTTTTTCCGAAGGTAACTGGCTTCAGCAGAGCGCAGATACCAAATACTGTTCTTCTAGT
GTAGCCGTAGTTAGGCCACCACTTCAAGAACTCTGTAGCACCGCCTACATACCTCGCTCTGCTA
ATCCTGTTACCAGTGGCTGCTGCCAGTGGCGATAAGTCGTGTCTTACCGGGTTGGACTCAAGAC
GATAGTTACCGGATAAGGCGCAGCGGTCGGGCTGAACGGGGGGTTCGTGCACACAGCCCAGCTT
GGAGCGAACGACCTACACCGAACTGAGATACCTACAGCGTGAGCTATGAGAAAGCGCCACGCTT
CCCGAAGGGAGAAAGGCGGACAGGTATCCGGTAAGCGGCAGGGTCGGAACAGGAGAGCGCACGA
GGGAGCTTCCAGGGGGAAACGCCTGGTATCTTTATAGTCCTGTCGGGTTTCGCCACCTCTGACT
TGAGCGTCGATTTTGTGATGCTCGTCAGGGGGCGGAGCCTATGGAAAAACGCCAGCAACGCG
GCCTTTTTACGGTTCCTGGCCTTTTGCTGGCCTTTTGCTCACATGTTCTTTCCTGCGTTATCCC
CTGATTCTGTGGATAACCGTATTACCGCCTTTGAGTGAGCTGATACCGCTCGCCGCAGCCGAAC
GACCGAGCGCAGCGAGTCAGTGAGCGAGGAAGCGGAAGAGCGCCTGATGCGGTATTTTCTCCTT
ACGCATCTGTGCGGTATTTCACACCGCATATGGTGCACTCTCAGTACAATCTGCTCTGATGCCG
CATAGTTAAGCCAGTATCTGCTCCCTGCTTGTGTGTTGGAGGTCGCTGAGTAGTGCGCGAGCAA
AATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCA
TACGTTGTATCTATATCATAATATGTACATTTATATTGGCTCATGTCCAATATGACCGCCATGT
TGACATTGATTATTGACTAGTTATTAATAGTAATCAATTACGGGGTCATTAGTTCATAGCCCAT
ATATGGAGTTCCGCGTTACATAACTTACGGTAAATGGCCCGCCTGGCTGACCGCCCAACGACCC
CCGCCCATTGACGTCAATAATGACGTATGTTCCCATAGTAACGCCAATAGGGACTTTCCATTGA
CGTCAATGGGTGGAGTATTTACGGTAAACTGCCCACTTGGCAGTACATCAAGTGTATCATATGC
CAAGTCCGCCCCCTATTGACGTCAATGACGGTAAATGGCCCGCCTGGCATTATGCCCAGTACAT
GACCTTACGGGACTTTCCTACTTGGCAGTACATCTACGTATTAGTCATCGCTATTACCATGGTG
ATGCGGTTTTGGCAGTACATCAATGGGCGTGGATAGCGGTTTGACTCACGGGGATTTCCAAGTC
TCCACCCCATTGACGTCAATGGGAGTTTGTTTTGGCACCAAAATCAACGGGACTTTCCAAAATG
TCGTAACAACTCCGCCCCATTGACGCAAATGGGCGGTAGGCGTGTACGGTGGGAGGTCTATATA
AGCAGAGCTCGTTTAGTGAACCGTCAGATCGCCTGGAGACGCCATCCACGCTGTTTTGACCTCC
ATAGAAGACACCGGGACCGATCCAGCCTCCGCGGGCGCGCGTCGACGGGCGACGCGAAACTTGG
GCCCACTCGACAAGAAAATGGCGGCGCGCGCCTCGGTCCTTAGCGGGGGCGAGTTGGAT
CGGTGGGAAAAGATCCGCTTGAGGCCAGGAGGGAAGAAGAAGTACAAGCTCAAGCACAT
CGTCTGGGCGAGCAGAGAGCTCGAGCGGTTCGCGGTCAACCCGGGCCTGCTTGAGACAT
CGGAGGGCTGTCGGCAAATCCTGGGGCAGCTTCAACCGTCCTTGCAAACGGGCAGCGAG
GAGCTGCGATCGCTATACAACACGGTAGCGGTCCTCTACTGCGTGCACCAGCGGATCGA
CGTCAAGGACACGAAGGAGGCTCTTGAGAAGATTGAGGAAGAGCAGAACAAGTCGCAGC
AGAAGACGCAGCAGGCGAAGGCCGCAGACGGCAAAGTATCTCAGAACTACCCGATCGTG
CAGAACGCGCAGGGACAGATGGTCCACCAGGCCATCTCCCACGGACGCTTAACGCCTG
GGTCAAAGTAATCGAGGAGAAGGGATTCAGCCCGGAAGTGATCCCCATGTTCTCGGCAC
TTGCGGAGGGAGCCACCCCGCAGGACCTGAACACGATGTTGAACACCATCGGCGGGCAC
CAGGCGGCCATGCAGATGCTTAAGGACACCATCAACGACGAGGCTGCGGAGTGGGACCG
GCTTCACCCGGTGCAGGCGGGGCCCGTCGCGCCGGGCCAGATCAGAGAGCCGCGGGGAT
CGGACATCGCGGGAACCACCAGCAACTTGCAGGAGCAAATCGGGTGGATGACTTCGAAC
CCCCGATCCCGGTCGGGGACATCTACAAGAGATGGATCATCATGGGGTTGAACAAGAT
CGTGAGGATGTACAGCCCGACCAGCATCCTGGACATCCGACAGGGACCGAAGGAGTCCT
TCAGAGACTACGTAGACCGGTTCTTCCGGACTCTCCGGGCGGAGCAGGCGTCGCAGGAG
```

Mosaic and Group M Gag_dmyr-patent.doc

Fig. 22 cont'd-25

```
GTCAAGAACTCGATGACGGAGACCTTGTTGGTCCAGAACTCGAACCCGGACTGCAAGAC
CATCCTGAAGGCTCTCGGCCCGGCGGCGACGTTGGAAGAGATGATGACGGCGTGCCAGG
GAGTCGGGGGACCCGGCCACAAGGCGCGGGTCTTGGCCGAGGCGATGAGCCAGGTGCAG
CAGCCGAACATCATGATGCAGCGGGGCAACTTCAAGGGACAGAAGCGGATCAAGTGTTT
CAACTGTGGCAGGGAGGGACACCTCGCCAGGAACTGCCGGGCCCCGCGGAAGAAGGGCT
GCTGGAAGTGCGGAAGGGAGGGGCACCAAATGAAGGACTGCACGGAGTCGAAGGCGAAT
TTCCTCGGGAAGATCTGGCCGTCCAACAAGGGGCGGCCAGGGAACTTTCTGCAAAGCCG
GCCGGAGCCGTCGGCCCCGCCGGCGGAGTCCTTTGGGTTCGGGGAGGAGATCACGCCCT
CGCAGAAGCAAGAGCAAAAGGACAAGGAGCTCTACCCTCTTGCGTCCCTCAAGTCGCTC
TTCGGCAACGACCCGCTTTCGCAATGATAAGCTAGCGGATCCTGATCAGGCGCGCCGAGCTCGC
TGATCAGCCTCGACTGTGCCTTCTAGTTGCCAGCCATCTGTTGTTTGCCCCTCCCCCGTGCCTT
CCTTGACCCTGGAAGGTGCCACTCCCACTGTCCTTTCCTAATAAAATGAGGAAATTGCATCGCA
TTGTCTGAGTAGGTGTCATTCTATTCTGGGGGGTGGGGTGGGGCAGGACAGCAAGGGGAGGAT
TGGGAAGACAATAGCAGGCATGCTGGGGAATTT
```

Thursday, August 2, 2007

Sequence 0    Length : 4836

| Enzyme | Site | Positions |
|---|---|---|
| AatII | GACGTC | 5 Sites: 2510, 2563, 2646, 2832, 3370 |
| AccI | GTMKAC | 2 Sites: 3050, 3970 |
| AccIII | TCCGGA | 1 Site: 3982 |
| AflII | CTTAAG | 1 Site: 3681 |
| AflIII | ACRYGT | 1 Site: 1897 |
| AluI | AGCT | 16 Sites: 109, 633, 1340, 1597, 1643, 1733, 1959, 2184, 2951, 3179, 3209, 3278, 3311, 4517, 4578, 4606 |
| AlwNI | CAGNNNCTG | 4 Sites: 1488, 2129, 3629, 4285 |
| AosII | GRCGYC | 7 Sites: 2507, 2560, 2643, 2829, 2983, 3367, 4005 |
| ApaI | GGGCCC | 3 Sites: 3075, 3745, 4295 |
| ApaLI | GTGCAC | 3 Sites: 1583, 2081, 3351 |
| AsuII | TTCGAA | 1 Site: 3834 |
| AvaI | CYCGRG | 3 Sites: 3210, 3230, 4374 |
| BamHI | GGATCC | 1 Site: 4554 |
| BanI | GGYRCC | 5 Sites: 538, 2850, 3658, 4333, 4690 |
| BanII | GRGCYC | 7 Sites: 2953, 3075, 3211, 3745, 4295, 4519, 4608 |
| BclI | TGATCA | 2 Sites: 4590, 4612 |
| BcnI | CCSGG | 14 Sites: 1173, 1521, 3021, 3232, 3233, 3577, 3730, 3755, 3850, 3994, 4063, 4096, 4148, 4291 |
| BglI | GCCNNNNNGGC | 4 Sites: 2475, 2597, 2668, 4449 |
| BglII | AGATCT | 2 Sites: 458, 4581 |
| Bsp1286 | GDGCHC | 13 Sites: 652, 1587, 2085, 2953, 3075, 3211, 3355, 3661, 3745, 4295, 4335, 4519, 4608 |
| BspHI | TCATGA | 3 Sites: 1007, 1105, 4204 |
| BspMI | TCCGGA | 1 Site: 3982 |
| BspNI | CCWGG | 18 Sites: 52, 1738, 1751, 1872, 2475, 2668, 2977, 3157, 3270, 3513, 3542, 3663, 3927, 4131, 4185, 4280, 4408, 4684 |
| BssHII | GCGCGC | 4 Sites: 3045, 3098, 3100, 4599 |
| BstNI | CCWGG | 18 Sites: 52, 1738, 1751, 1872, 2475, 2668, 2977, 3157, 3270, 3513, 3542, 3663, 3927, 4131, 4185, 4280, 4408, 4684 |
| BstXI | CCANNNNNNTGG | 1 Site: 3926 |
| Cfr10I | RCCGGY | 5 Sites: 847, 3718, 3973, 4426, 4448 |
| CfrI | YGGCCR | 7 Sites: 769, 3667, 4148, 4166, 4386, 4404, 4428 |
| ClaI | ATCGAT | 1 Site: 2287 |
| DdeI | CTNAG | 13 Sites: 12, 204, 397, 711, 787, 1216, 1623, 2088, 2158, 2229, 3111, 3456, 4744 |
| DpnI | GATC | 26 Sites: 190, 195, 460, 1239, 1247, 1258, 1333, 2972, 3028, 3130, 3144, 3317, 3363, 3480, 3585, 3762, 3779, 3846, 3876, 3897, 4242, 4363, 4479, 4586, 4592, 4614 |
| DraIII | CACNNNGTG | |

Mosaic and Group M Gag_dmyr-patent.doc

Fig. 22 cont'd-26

```
2 Sites                      21 Sites                      3513    3542    3576
    1761    3731                 11     496    1273        3663    3729    3754
Eco47I  GGWCC                 1382    1556    1656        3849
13 Sites                      1723                            3927    3993    4062
    122     586     919          1993    2026    2169        4095    4131    4147
    1048    3021    3106         2249    3045    3047        4165
    3337                         3098                            4280    4290    4408
    3585    3625    3715         3100    3102    3494        4684
    3941    4045    4142         3752    4160    4599    NaeI    GCCGGC
EcoO109 RGGNCCY               4601                        2 Sites
4 Sites                       HincII  GTYRAC                 4428    4450
    3626    3741    4143     5 Sites                    NciI    CCSGG
    4292                         413     886     2369    14 Sites
EcoRII  CCWGG                    3051    3227                1172    3520    3020
18 Sites                      HinfI   GANTC                  3231    3232    3576
    50      1736    1749     19 Sites                        3729
    1870    2473    2666         43      59      357         3754    3849    3993
    2975                         383     401     725    779  4052    4095    4147
    3155    3259    3511         807     1527    1923        4290
    3540    3561    3925         1998    2222    2795    NcoI    CCATGG
    4129                         3568                    1 Site
    4183    4278    4406         3951    3986    4135        2745
    4682                         4356    4455            NdeI    CATATG
EcoRV   GATATC                HinPI   GCGC                2 Sites
1 Site                        21 Sites                       2076    2619
    2294                         9       494     1271    NheI    GCTAGC
Fnu4HI  GCNGC                    1380    1554    1654    1 Site
31 Sites                         1721                            4578
    234     769     1283         1991    2024    2167    NlaIII  CATG
    1489    1492    1557         2247    3043    3045    18 Sites
    1700                         3096                        532     762     864   
    1835    1973    1976         3098    3100    3492    892    1011    1109   1181
    1994    2110    2250         3750    4158    4597        1901    2218    2349
    2279                         4599                        2367    2689    2749
    2282    3094    3276     HpaII   CCGG                    3593
    3302    3312    3423     23 Sites                        3574    3884    4208
    3435                         848     1172    1329        4625
    3448    3687    3706         1519    1545    1692    NlaIV   GGNNCC
    3771    4099    4191         3019                    23 Sites
    4194                         3231    3576    3719        92      540     1830
    4212    4310    4404         3729    3753    3849        1869    2853    3023
FnuDII  CGCG                     3974                        3073
21 Sites                         3983    3992    4062        3614    3660    3717
    494     1273    1854         4095    4147    4289        3742    3743    3794
    2169    2257    2281         4427                        3943
    2445                         4431    4449                4144    4165    4293
    3039    3045    3047     MaeI    CTAG                    4294    4335    4435
    3062    3098    3100     7 Sites                         4444
    3222                         378     801     1034        4536    4692
    3492    3750    3773         1404    2385    4579    NruI    TCGCGA
    3799    4150    4298         4634                    1 Site
    4599                    MaeII   ACGT                     2257
HaeII   RGCGCY               13 Sites                   NsiI    ATGCAT
3 Sites                          669     1160    1196    1 Site
    12      1657    2027         2306    2507    2519        796
HaeIII  GGCC                     2560                    Nsp7524I RCATGY
26 Sites                         2643    2724    2829    2 Sites
    55      771     1175         3367    3967    4104        1901    4825
    1423    1857    1875     MaeIII  GTNAC               NspBII  CMGCKG
    1886                     8 Sites                     8 Sites
    2268    2469    2662         270     1134    1361        1314    1559    2281
    3073    3155    3235         1477    1540    2446        3039    3359    3773
    3447                         2533                        4214
    3516    3669    3743         2882                        4298
    3757    4093    4150     MvaI    CCNGG               PpuMI   RGGWCCY
    4170                     32 Sites                    2 Sites
    4293    4388    4406         52      1172    1529        3626    4143
    4430    4443                 1738    1751    1872    PstI    RSGNCCY
EgiAI   GWGCWC                   2475                    4 Sites
7 Sites                          2668    2977    3020        3529    3744    4140
    1687    2035    2953         3157    3231    3232        4295
    3211    3355    4518         3270                    PvuI    CGATCG
    4605                                                 2 Sites
HhaI    GCGC                                                 3318    3481
Mosaic and Group M Gag_dmyr-patent.doc
```

Fig. 22 cont'd-27

```
RsaI      GTAC                    SrfPI     CCNGG                   603      991
11 Sites                          32 Sites                          StuI     AGGCCT
     559     2093     2263             52     1172     1520         1 Site
    2330     2604     2684           1738     1751     1872              55
    2717                             2475                           StyI     CCWWGG
    2766     2925     3174           2668     2977     3020         1 Site
    3909                             3157     3231     3232              2745
SacI      GAGCTC                     3270                           TaqI     TCGA
4 Sites                                 3513     3542     3576      12 Sites
    2953     3211     4519             3663     3729     3764            216     1799     2287
    4608                               3849                             3050     3079     3211
SacII     CCGCGG                         3927     3993     4062         3364
4 Sites                                  4096     4131     4147         3556     3834     4056
    2282     3040     3774             4185                             4359     4621
    4299                                  4280     4290     4408    XhoI     CTCGAG
SalI      GTCGAC                         4684                       1 Site
1 Site                             SdnI     GDGCHC                       3210
    3049                           13 Sites                          XhoII    RGATCY
Sau3A     GATC                        652     1587     2085         6 Sites
26 Sites                             2953     3079     3211             458     1245     1256
     188      193      456            3355                             3142     4381     4584
    1237     1245     1256              3661     3745     4295     XmaI     CCCGGG
    1331                                 4336     4519     4608     1 Site
    2970     3026     3128         SinI     GGWCC                       3230
    3142     3315     3361         13 Sites                         XmaIII   CGGCCG
    3478                              123      587      920         1 Site
    3583     3760     3777           1049     3022     3107             4428
    3844     3874     3895           3338                           XmnI     GAANNNNTTC
    4240                                 3506     3626     3716     2 Sites
    4381     4477     4584              3942     4046     4143          811     3567
    4590     4612                   SmaI     CCCGGG
Sau96A    GGNCC                    1 Site                           Following enzymes have no
27 Sites                              3232                          sites
     123      587      920         SnaBI    TACGTA                  Asp718   AvrII    BalI
    1049     1174     2265         2 Sites                          BbeI     BstEII   DraI
    2468                              2725     3968                 Eco47III EcoRI    EspI
    2661     3022     3071         SpeI     ACTAGT                  FspI     HindIII  HpaI
    3072     3107     3233         1 Site                           KpnI     MluI     MstI
    3338                              2384                          NarI     NotI     OxaNI
    3506     3626     3716         SphI     GCATGC                  PflMI    PstI     PvuII
    3741     3742     3755         1 Site                           RsrII    ScaI     SfiI
    3942                              4825                          SplI     Tth111I  XbaI
    4046     4092     4143         SspI     AATATT                  XcaI
    4291     4292     4442         2 Sites
```

```
Gag_M4.2 Dmyr
MAARASVLSGGKLDAWEKIRLRPGGKKKYRLKHLVWASRELDRFALNPSLLETAEGCKQIMKQL
QPALKTGTEELKSLYNTVATLYCVHEKIDVRDTKEALDKIEEEQNKIQQKTQQAKEADGKVSQN
YPIVQNIQGQMVHQPISPRTLNAWVKVVEEKAFSPEVIPMFTALSDGATPQDLNSMLNAVGGHQ
AAMQILKDTINEEAADWDRLHPVHAGPVAPGQMREPRGSDIAGTTSTLQEQIGWMTNNPPIPVG
EIYKRWIILGLNKIVRMYSPVSILDIKQGPKESFRDYVDRFFKVLRAEQATQDVKNWMTDTLLI
QNANPDCKSILRALGPGATLEEMMTACQGVGGPSHKARILAEAMSQVTNSATIMMQRGNFRNQR
KTVKCFNCGKEGHLARNCKAPRKRGCWKCGKEGHQMKECTERQANFLGKIWPSSKGRPGNFPQS
RPEPTAPPEESFRFGEETTTPSQKQEPIDKELYPLASLRSLFGNDPSSQAS HV13316 (Gag_M4.2 Dmyr.wlv) cloned in to XhoI
GTCGAGAAGAAAATGGCGGCTCGCGCCTCGGTCCTTAGCGGGGGCAAGTTGGATGCGTGGGAAA
AGATCCGCTTGAGGCCAGGAGGGAAGAAGAAGTACCGGCTCAAGCACCTTGTCTGGGCGAGCAG
AGAGCTCGACCGGTTCGCGCTGAACCCGTCGCTGCTTGAGACAGCCGAGGGCTGCAAGCAAATC
ATGAAGCAGCTTCAACCGGCGTTGAAGACGGGCACGGAGGAGCTGAAGTCGCTATACAACACGG
TAGCGACGCTCTACTGCGTGCACGAGAAGATCGACGTCAGGGACACGAAGGAGGCTCTTGACAA
```

Mosaic and Group M Gag_dmyr-patent.doc

Fig. 22 cont'd-28

```
GATTGAGGAAGAGCAGAACAAGATCCAGCAGAAGACGCAGCAGGCGAAGGAGGCAGACGGCAAA
GTATCTCAGAACTACCCGATCGTGCAGAACATCCAGGGACAGATGGTCCACCAGCCGATCTCCC
CACGGACGCTTAACGCCTGGGTCAAAGTAGTCGAGGAGAAGGCATTCAGCCCGGAAGTGATCCC
CATGTTCACTGCACTTAGCGACGGAGCCACCCCGCAGGACCTGAACAGCATGTTGAACGCCGTC
GGCGGGCACCAGGCGGCCATGCAGATCCTTAAGGACACCATCAACGAGGAGGCTGCGGACTGGG
ACCGGCTTCACCCGGTGCACGCGGGGCCCGTCGCGCCGGGCCAGATGAGAGAGCCGCGGGATC
GGACATCGCGGGAACCACCAGCACCTTGCAGGAGCAAATCGGGTGGATGACTAACAACCCCCCG
ATCCCGGTCGGGGAGATCTACAAGAGATGGATCATCCTGGGGTTGAACAAGATCGTGAGGATGT
ACAGCCCAGTCAGCATCCTGGACATCAAGCAGGGACCGAAGGAGTCGTTCAGAGACTACGTCGA
CCGGTTCTTCAAAGTCCTCCGGGCGGAGCAGGCGACGCAGGACGTCAAGAACTGGATGACGGAC
ACCTTGTTGATCCAGAACGCGAACCCGGACTGCAAGTCGATCCTGCGGGCTCTCGGCCCGGGAG
CGACGTTGGAAGAGATGATGACGGCGTGCCAGGGAGTCGGGGGACCCTCGCACAAGGCGCGGAT
CTTGGCCGAGGCGATGTCACAAGTGACTAACAGCGCGACCATCATGATGCAGCGGGGCAACTTC
CGGAACCAGCGGAAGACGGTGAAGTGTTTCAACTGTGGCAAGGAGGGACACCTCGCCAGGAACT
GCAAGGCCCCGCGGAAGCGGGGCTGCTGGAAGTGCGGAAAGGAGGGGCACCAAATGAAGGAGTG
CACGGAGCGGCAGGCGAATTTCCTCGGGAAGATCTGGCCGTCCTCGAAGGGGCGGCCAGGGAAC
TTTCCGCAAAGCCGGCCGGAGCCGACGGCCCCGCCGGAGGAGTCCTTTCGGTTCGGGGAGGAGA
CGACCACGCCCTCGCAGAAGCAAGAGCCGATCGACAAGGAGCTCTACCCTCTTGCGTCCCTCCG
GTCGCTCTTCGGCAACGACCCGTCGTCGCAAGCGTCGTGATAAGCTAGCGGATCCGGCGCGCC
                                        NheI      AscI
>HV13316 in HV10001 4816bp
AAATGGGGGCGCTGAGGTCTGCCTCGTGAAGAAGGTGTTGCTGACTCATACCAGGCCTGAATCG
CCCCATCATCCAGCCAGAAAGTGAGGGAGCCACGGTTGATGAGAGCTTTGTTGTAGGTGGACCA
GTTGGTGATTTTGAACTTTTGCTTTGCCACGGAACGGTCTGCGTTGTCGGGAAGATGCGTGATC
TGATCCTTCAACTCAGCAAAAGTTCGATTTATTCAACAAAGCCGCCGTCCCGTCAAGTCAGCGT
AATGCTCTGCCAGTGTTACAACCAATTAACCAATTCTGCGTTCAAAATGGTATGCGTTTTGACA
CATCCACTATATATCCGTGTCGTTCTGTCCACTCCTGAATCCCATTCCAGAAATTCTCTAGCGA
TTCCAGAAGTTTCTCAGAGTCGGAAAGTTGACCAGACATTACGAACTGGCACAGATGGTCATAA
CCTGAAGGAAGATCTGATTGCTTAACTGCTTCAGTTAAGACCGACGCGCTCGTCGTATAACAGA
TGCGATGATGCAGACCAATCAACATGGCACCTGCCATTGCTACCTGTACAGTCAAGGATGGTAG
AAATGTTGTCGGTCCTTGCACACGAATATTACGCCATTTGCCTGCATATTCAAACAGCTCTTCT
ACGATAAGGGCACAAATCGCATCGTGGAACGTTTGGGCTTCTACCGATTTAGCAGTTTGATACA
CTTTCTCTAAGTATCCACCTGAATCATAAATCGGCAAAATAGAGAAAATTGACCATGTGTAAG
CGGCCAATCTGATTCCACCTGAGATGCATAATCTAGTAGAATCTCTTCGCTATCAAAATTCACT
TCCACCTTCCACTCACCGGTTGTCCATTCATGGCTGAACTCTGCTTCCTCTGTTGACATGACAC
ACATCATCTCAATATCCGAATACGGACCATCAGTCTGACGACCAAGAGAGCCATAAACACCAAT
AGCCTTAACATCATCCCCATATTTATCCAATATTCGTTCCTTAATTTCATGAACAATCTTCATT
CTTTCTTCTAGTCATTATTATTGGTCCGTTCATAACACCCCTTGTATTACTGTTTATGTAAG
CAGACAGTTTTATTGTTCATGATGATATATTTTTATCTTGTGCAATGTAACATCAGAGATTTTG
AGACACAACGTGGCTTTCCCCGGCCCATGACCAAAATCCCTTAACGTGAGTTTTCGTTCCACTG
AGCGTCAGACCCCGTAGAAAAGATCAAAGGATCTTCTTGAGATCCTTTTTTTCTGCGCGTAATC
TGCTGCTTGCAAACAAAAAAACCACCGCTACCAGCGGTGGTTTGTTTGCCGGATCAAGAGCTAC
CAACTCTTTTTCCGAAGGTAACTGGCTTCAGCAGAGCGCAGATACCAAATACTGTTCTTCTAGT
GTAGCCGTAGTTAGGCCACCACTTCAAGAACTCTGTAGCACCGCCTACATACCTCGCTCTGCTA
ATCCTGTTACCAGTGGCTGCTGCCAGTGGCGATAAGTCGTGTCTTACCGGGTTGGACTCAAGAC
GATAGTTACCGGATAAGGCGCAGCGGTCGGGCTGAACGGGGGGTTCGTGCACACAGCCCAGCTT
GGAGCGAACGACCTACACCGAACTGAGATACCTACAGCGTGAGCTATGAGAAAGCGCCACGCTT
CCCGAAGGGAGAAAGGCGGACAGGTATCCGGTAAGCGGCAGGGTCGGAACAGGAGAGCGCACGA
GGGAGCTTCCAGGGGGAAACGCCTGGTATCTTTATAGTCCTGTCGGGTTTCGCCACCTCTGACT
```

Fig. 22 cont'd-29

```
TGAGCGTCGATTTTTGTGATGCTCGTCAGGGGGCGGAGCCTATGGAAAAACGCCAGCAACGCG
GCCTTTTTACGGTTCCTGGCCTTTTTGCTGGCCTTTTGCTCACATGTTCTTTCCTGCGTTATCCC
CTGATTCTGTGGATAACCGTATTACCGCCTTTGAGTGAGCTGATACCGCTCGCCGCAGCCGAAC
GACCGAGCGCAGCGAGTCAGTGAGCGAGGAAGCGGAAGAGCGCCTGATGCGGTATTTTCTCCTT
ACGCATCTGTGCGGTATTTCACACCGCATATGGTGCACTCTCAGTACAATCTGCTCTGATGCCG
CATAGTTAAGCCAGTATCTGCTCCCTGCTTGTGTGTTGGAGGTCGCTGAGTAGTGCGCGAGCAA
AATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCA
TACGTTGTATCTATATCATAATATGTACATTTATATTGGCTCATGTCCAATATGACCGCCATGT
TGACATTGATTATTGACTAGTTATTAATAGTAATCAATTACGGGGTCATTAGTTCATAGCCCAT
ATATGGAGTTCCGCGTTACATAACTTACGGTAAATGGCCCGCCTGGCTGACCGCCCAACGACCC
CCGCCCATTGACGTCAATAATGACGTATGTTCCCATAGTAACGCCAATAGGGACTTTCCATTGA
CGTCAATGGGTGGAGTATTTACGGTAAACTGCCCACTTGGCAGTACATCAAGTGTATCATATGC
CAAGTCCGCCCCCTATTGACGTCAATGACGGTAAATGGCCCGCCTGGCATTATGCCCAGTACAT
GACCTTACGGGACTTTCCTACTTGGCAGTACATCTACGTATTAGTCATCGCTATTACCATGGTG
ATGCGGTTTTGGCAGTACATCAATGGGCGTGGATAGCGGTTTGACTCACGGGGATTTCCAAGTC
TCCACCCCATTGACGTCAATGGGAGTTTGTTTTGGCACCAAAATCAACGGGACTTTCCAAAATG
TCGTAACAACTCCGCCCCATTGACGCAAATGGGCGGTAGGCGTGTACGGTGGGAGGTCTATATA
AGCAGAGCTCGTTTAGTGAACCGTCAGATCGCCTGGAGACGCCATCCACGCTGTTTTGACCTCC
ATAGAAGACACCGGGACCGATCCAGCCTCCGCGGGCGCGCGTCGAGAAGAAAATGGCCGCTCGC
GCCTCGGTCCTTAGCGGGGGCAAGTTGGATGCGTGGAAAAGATCCGCTTGAGGCCAGGAGCGA
AGAAGAAGTACCGGCTCAAGCACCTTGTCTGGGCGAGCAGAGAGCTCGACCGGTTCGCGCTGAA
CCCGTCGCTGCTTGAGACAGCCGAGGGCTGCAAGCAAATCATGAAGCAGCTTCAACCGGCGTTG
AAGACGGGCACGGAGGAGCTGAAGTCGCTATACAACACGGTAGCGACGCTCTACTGCGTGCACG
AGAAGATCGACGTCAGGGACACGAAGGAGGCTCTTGACAAGATTGAGGAAGAGCAGAACAAGAT
CCAGCAGAAGACGCAGCAGGCGAAGGAGGCAGACGGCAAAGTATCTCAGAACTACCCGATCGTG
CAGAACATCCAGGGACAGATGGTCCACCAGCCGATCTCCCCACGGACGCTTAACGCCTGGGTCA
AAGTAGTCGAGGAGAAGGCATTCAGCCCGGAAGTGATCCCCATGTTCACTGCACTTAGCGACGG
AGCCACCCCGCAGGACCTGAACAGCATGTTGAACGCCGTCGGCGGGCACCAGGCGGCCATGCAG
ATCCTTAAGGACACCATCAACGAGGAGGCTGCGGACTGGGACCGGCTTCACCCGGTGCACGCGG
GGCCCGTCGCGCCGGGCCAGATGAGAGAGCCGCGGGGATCGGACATCGCGGGAACCACCAGCAC
CTTGCAGGAGCAAATCGGGTGGATGACTAACAACCCCCGATCCCGGTCGGGGAGATCTACAAG
AGATGGATCATCCTGGGGTTGAACAAGATCGTGAGGATGTACAGCCCAGTCAGCATCCTGGACA
TCAAGCAGGGACCGAAGGAGTCGTTCAGAGACTACGTCGACCGGTTCTTCAAAGTCCTCCGGGC
GGAGCAGGCGACGCAGGACGTCAAGAACTGGATGACGGACACCTTGTTGATCCAGAACGCGAAC
CCGGACTGCAAGTCGATCCTGCGGGCTCTCGGCCCGGGAGCGACGTTGGAAGAGATGATGACGG
CGTGCCAGGGAGTCGGGGGACCCTCGCACAAGGCGCGGATCTTGGCCGAGGCGATGTCACAACT
GACTAACAGCGCGACCATCATGATGCAGCGGGGCAACTTCCGGAACCAGCGGAAGACGGTGAAG
TGTTTCAACTGTGGCAAGGAGGGACACCTCGCCAGGAACTGCAAGGCCCCGCGGAAGCGGGCT
GCTGCAAGTGCGGAAAGGAGGGGCACCAAATGAAGGAGTGCACGGAGCGGCAGGCGAATTTCCT
CGGGAAGATCTGGCCGTCCTCGAAGGGGCGGCCAGGGAACTTTCCGCAAAGCCGGCCGGAGCCG
ACGGCCCCGCCGGAGGAGTCCTTTCGGTTCGGGGAGGAGACGACCACGCCCTCGCAGAAGCAAG
AGCCGATCGACAAGGAGCTCTACCCTCTTGCGTCCCTCCGGTCGCTCTTCGGCAACGACCCGTC
GTCGCAAGCGTCGTGATAAGCTAGCGGATCCGGCGCGCCAGCTCGCTGATCAGCCTCGACTGT
GCCTTCTAGTTGCCAGCCATCTGTTGTTTGCCCCTCCCCCGTGCCTTCCTTGACCCTCGAAGGT
GCCACTCCCACTGTCCTTTCCTAATAAAATGAGGAAATTGCATCGCATTGTCTGAGTAGGTGTC
ATTCTATTCTGGGGGGTGGGGTGGGGCAGGACAGCAAGGGGGAGGATTGGGAAGACAATAGCAG
GCATGCTGGGGAATTT
```

Thursday, August 2, 2007    Sequence 1    Length : 4816    AatII    GACGTC
                                                          6 Sites Mosaic and Group M Gag_dmyr-patent.doc

Fig. 22 cont'd-30

```
          2510    2563    2646              3632    3707    3716              3596    3686    3912
2832    3341    3989              4059    4313    4330              4113
AccI      GTMKAC                  4499                              EcoO105   RGGNCCY
1 Site                                    4588                      4 Sites
     3941                         BspHI     TCATGA                        3597    3712    4114
AccIII    TCCGGA                  4 Sites                           4269
1 Site                                    1007    1105    3239      EcoRII    CCWGG
     4199                         4178                              17 Sites
AflII     CTTAAG                  BspMII    TCCGGA                        50    1736    1749
1 Site                            1 Site                            1870    2473    2666
     3652                              4199                         2977
AflIII    ACRYGT                  BspNI     CCWGG                   3128    3466    3513
1 Site                            17 Sites                          3634    3853    3898
     1897                              52    1738    1751           4102
AluI      AGCT                    1872    2475    2668                   4255    4383    4662
15 Sites                          2977                              EcoRV     GATATC
      109     633    1340         3128    3466    3513              1 Site
1597    1643    1733              3634    3853    3898                   2294
1959                              4102                              Fnu4HI    GCNGC
     2184    2951    3180              4257    4385    4664         27 Sites
3249    3282    4497              BssHII    GCGCGC                       234     769    1283
4564                              2 Sites                           1489    1492    1557
     4586                              3045    4579                 1700
AlwNI     CAGNNNCTG               BstNI     CCWGG                        1855    1973    1976
4 Sites                           17 Sites                          1994    2110    2150
     1488    2129    3600              52    1738    1751           2279
4262                              1872    2475    2668                   2282    3065    3208
AosII     GRCGYC                  2977                              3228    3247    3406
7 Sites                           3128    3466    3513              3638
     2507    2560    2643         3634    3853    3898                   3677    3742    4186
2829    2983    3336              4102                              4287    4336    4381
3986                                   4257    4385    4664         FnuDII    CGCG
ApaI      GGGCCC                  Cfr10I    RCCGGY                  21 Sites
1 Site                            7 Sites                                494    1273    1854
     3716                              847    3146    3185          2169    2257    2281
ApaLI     GTGCAC                  3255    3689    3944              2445
5 Sites                           4403                                   3039    3045    3047
     1583    2081    3322         CfrI      YGGCCR                  3071    3193    3709
3703    4326                      6 Sites                           3721
AvaI      CYCGRG                       769    3638    4139               3744    3760    4027
2 Sites                           4363    4381    4405              4131    4171    4275
     4065    4351                 ClaI      ATCGAT                  4579
BamHI     GGATCC                  1 Site                            HaeII     RGCGCY
1 Site                                 2287                         3 Sites
     4570                         DdeI      CTNAG                         12    1657    2027
BanI      GGYRCC                  14 Sites                          HaeIII    GGCC
5 Sites                                12     204     397           21 Sites
      538    2850    3629          711     787    1214    1623            55     771    1176
4310    4670                           2088    2158    2229         1423    1857    1875
BanII     GRGCYC                  3082    3437    3574              1886
6 Sites                           4724                                   2268    2469    2562
     2953    3182    3716         DpnI      GATC                    3126    3640    3714
4059    4499    4588              28 Sites                          3728
BclI      TGATCA                       190     195     460               4064    4141    4270
1 Site                            1239    1247    1258              4365    4383    4407
     4592                         1333                              4420
BcnI      CCSGG                        2972    3028    3115         HgiAI     GWGCWC
11 Sites                          3334    3391    3451              9 Sites
     1173    1521    3021         3490                                   1587    2088    2953
3548    3701    3726                   3556    3649    3750         3182    3326    3707
3821                              3817    3832    3847              4330
     3965    4034    4067         3868                                   4499    4588
4068                                   4018    4048    4135         HhaI      GCGC
BglI      GCCNNNNNGGC             4360    4486    4572              20 Sites
3 Sites                           4594                                    11     496    1273
     2475    2597    2668         DraIII    CACNNNGTG               1383    1556    1656
BglII     AGATCT                  2 Sites                           1723
3 Sites                                1161    3702                      1993    2026    2169
      450    3630    4358         Eco47I    GGWCC                   2249    3045    3047
Bsp1286   GDGCHC                  11 Sites                          3073
15 Sites                               122     586     919               3195    3723    4131
      652    1587    2985         1048    3021    3077              4171    4579    4581
2953    3182    3274              3476                              HincII    GTYRAC
3326                                                                4 Sites
Mosaic and Group M Gag_dmyr-patent.doc
```

Fig. 22 cont'd-31

```
          413      886     2369              3964    4033    4066           3940
3942                                  4067                            Sau3A     GATC
HinfI     GANTC                       NcoI    CCATGG                  28 Sites
16 Sites                              1 Site                                  168     193      458
          43       59      367                2745                    1237    1245    1256
383       401      725     779        NdeI    CATATG                  1331
          807      1527    1923       2 Sites                                 2970    3026    3113
1998      2022     2795                       2076    2619            3332    3389    3449
3922                                  NheI    GCTAGC                  3488
          4106     4432               1 Site                                  3554    3647    3748
HinPI     GCGC                                4554                    3815    3830    3845
20 Sites                              NlaIII  CATG                    3866
          9        494     1271       19 Sites                                4016    4046    4131
1380      1554     1654                       538     762     864     4358    4484    4570
1721                                  892     1011    1109    1181    4592
          1991     2024    2167               1901    2219    2349    Sau96A   GGNCC
2247      3043     3045               3367    2689    2749            21 Sites
3073                                  3243                                    123     587     920
          3193     3721    4128               3564    3612    3645    1049    1174    2256
4169      4577     4579               4182    4805                    2469
HpaII     CCGG                        NlaIV   GGNNCC                           2661    3022    3078
25 Sites                              22 Sites                        3477    3597    3687
          848      1172    1329               92      540     1830    3712
1519      1545     1692               1869    2852    3023                    3713    3726    3913
3019                                  3585                            4063    4114    4269
          3147     3186    3256               3631    3688    3713    4419
3547      3690     3700               3714    3765    3914            ScrFI    CCNGG
3724                                  4115                            28 Sites
          3920     3945    3963               4116    4204    4271            52     1172    1520
4033      4066     4200               4312    4412    4421            1738    1751    1872
4404                                  4572                            2475
          4408     4426    4518       4672                                    2668    2977    3020
4574                                  NruI    TCGCGA                  3128    3466    3513
MaeI      CTAG                        1 Site                          3547
7 Sites                                       2257                            3634    3700    3725
          378      803     1034       NsiI    ATGCAT                  3820    3853    3898
1404      2385     4565               1 Site                          3964
4614                                          796                             4033    4066    4067
MaeII     ACGT                        Nsp7524I  RCATGY                4102    4257    4385
14 Sites                              3 Sites                         4664
          669      1160    1196               1901    3612    4805    SduI     GDGCHC
2306      2507     2529               NspBII  CMGCKG                  15 Sites
2560                                  8 Sites                                 652    1587    2085
          2643     2724    2829               1314    1559    2281    2950    3182    3274
3338      3938     3986               3039    3744    4188            3326
4075                                  4209                                    3632    3707    3716
MaeIII    GTNAC                       4275                            4059    4313    4330
10 Sites                              PpuMI   RGGWCCY                 4499
          270      1134    1361       2 Sites                         4588
1477      1540     2446                       3597    4114            SinI     GGWCC
2533                                  PssI    RGGNCCY                 11 Sites
          2882     4151    4158       4 Sites                                 123     587     920
MvaI      CCNGG                               3600    3715    4117    1049    3022    3028
28 Sites                              4272                            3477
          52       1172    1520       PvuI    CGATCG                          3597    3687    3913
1738      1751     1872               2 Sites                         4114
2475                                          3452    4487            SmaI     CCCGGG
          2668     2977    3020       RsaI    GTAC                    1 Site
3128      3466     3513               11 Sites                                4067
3547                                          559     2093    2263    SnaBI    TACGTA
          3634     3700    3725       2338    2604    2684            1 Site
3820      3853     3898               2717                                    2725
3964                                          2769    2925    3145    SpeI     ACTAGT
          4033     4066    4067       3880                            1 Site
4102      4257     4385               SacI    GAGCTC                          2384
4664                                  4 Sites                         SphI     GCATGC
NaeI      CCCGGC                              2953    3182    4499    1 Site
1 Site                                4588                                    4805
          4405                        SacII   CCGCGG                  SspI     AATATT
NciI      CCSGG                       4 Sites                         2 Sites
11 Sites                                      2282    3040    3745            503     991
          3172     1520    3020       4275                            StuI     AGGCCT
3547      3700     3725               SalI    GTCGAC                  1 Site
3820                                  1 Site                                  55
Mosaic and Group M Gag_dmyr-patent.doc
```

| | | | | | |
|---|---|---|---|---|---|
| StyI | CCWWGG | | Tth111I | GACNNNGTC | |
| 1 Site | | | 1 Site | | |
| 2749 | | | 3937 | | |
| TaqI | TCGA | | XhoII | RGATCY | |
| 12 Sites | | | 10 Sites | | |
| 216 | 1799 | 2287 | 458 | 1245 | 1256 |
| 3050 | 3182 | 3335 | 3113 | 3389 | 3647 |
| 3527 | | | 3830 | | |
| 3941 | 4045 | 4372 | 4133 | 4358 | 4570 |
| 4497 | 4601 | | XmaI | CCCGGG | |

| | |
|---|---|
| 1 Site | |
| 4065 | |
| XmaIII | CGGCCG |
| 1 Site | |
| 4405 | |
| XmnI | GAANNNNTTC |
| 3 Sites | |
| 811 | 3538 4225 |

Need re-create XhoI site at the 5' end
Primer:
Gag-M2-4-fG/C:
GGGCGCCTCGAGAAGAAAATGGCGGCTCG Gag_M4.3 Dmyr
MAARASILRGGKLDKWEKIRLRPGGKKRYMLKHLIWASRELERFALNPGLLETAEGCQQIIEQL
QSTLKTGSEELKSLFNTVATLYCVHQRIEVKDTKEALDKVEEEQNKSKKKAQQAAADTGNSSQV
SQNYPIVQNLQGQMVHQALSPRTLNAWVKVIEEKAFSPEIIPMFTALSEGATPSDLNTMLNTVG
GHQAAMQMLKDTINEEAAEWDRVHPVHAGPIPPGQMREPRGSDIAGTTSSLQEQIAWMTSNPPV
PVGEIYKRWIVLGLNKIVRMYSPVSILDIRQGPKEPFRDYVDRFFKTLRAEQASQDVKNWMTET
LLVQNANPDCKTILRALGPGASLEEMMTACQGVGGPSHKARVLAEAMSQTNSAILMQRSNFKGS
KRIVKCFNCGKEGHIARNCRAPRKRGCWKCGQEGHQMKDCNERQANFLGKIWPSHKGRPGNFLQ
NRPEPTAPPEPTAPPAESFRFEETTPAPKQELKDREPLTSLKSLFGSDPLSQAS HV13317 (Gag_M4.3 Dmyr.wlv)
GTCGAGAAGAAAATGGCGGCTCGCGCCTCGATCCTTCGAGGGGGCAAGTTGGATAAGTGGGAAA
AGATCCGCTTGAGGCCAGGAGGGAAGAAGAGATACATGCTCAAGCACCTGATCTGGGCGAGCAG
AGAGCTGGAGCGGTTCGCGCTGAACCCGGGCCTGCTTGAGACAGCGGAGGGCTGTCAGCAAATC
ATCGAGCAGCTTCAAAGCACGCTGAAGACGGGCAGCGAGGAGCTGAAGTCGCTATTCAACACGG
TAGCGACCCTCTACTGCGTGCACCAGCGGATCGAGGTCAAGGACACGAAGGAGGCTCTTGACAA
GGTGGAGGAAGAGCAGAACAAGTCGAAGAAGAAGGCGCAGCAGGCGGCGGCCGACACCGGCAAC
TCCTCACAAGTATCTCAGAACTACCCGATCGTGCAGAACCTGCAGGGACAGATGGTCCACCAGG
CCCTCTCCCCACGGACGCTTAACGCCTGGGTCAAAGTAATCGAGGAGAAGGCCTTCAGCCCGGA
AATCATCCCCATGTTCACAGCACTTTCCGAGGGAGCCACCCCGAGCGACCTGAACACGATGTTG
AACACCGTCGGCGGGCACCAGGCGGCCATGCAGATGCTTAAGGACACCATCAACGAGGAGGCTG
CGGAGTGGGACCGGGTGCACCCGGTGCACGCGGGGCCCATCCCACCGGGCCAGATGAGAGAGCC
GCGGGGATCGGACATCGCGGGAACCACCAGCAGCTTGCAGGAGCAAATCGCCTGGATGACTTCG
AACCCCCCGGTCCCGGTCGGGGAGATCTACAAGAGATGGATCGTCCTCGGGTTGAACAAGATCG
TGAGGATGTACAGCCCTGTGTCAATCCTGGACATCCGACAGGGACCGAAGGAGCCCTTCAGAGA
CTACGTCGACCGGTTCTTCAAGACTCTCCGGGCGGAGCAGGCGTCGCAGGACGTCAAGAACTGG
ATGACGGAGACCTTGTTGGTCCAGAACGCTAACCCGGACTGCAAGACCATCCTGCGCGCTCTCG
GCCCGGGAGCGTCCTTGGAAGAGATGATGACGGCGTGCCAGGGAGTCGGGGGACCCTCACACAA
GGCGCGGGTCTTGGCCGAGGCGATGAGCCAGACGAACTCCGCCATCCTCATGCAGCGGTCCAAC
TTCAAGGGAAGCAAGCGGATCGTCAAGTGTTTCAACTGTGGCAAGGAGGGACACATCGCCAGGA
ACTGCCGGGCCCCGCGGAAGCGAGGCTGCTGGAAGTGCGGACAGGAGGGGCACCAAATGAAGGA
CTGCAACGAGCGCCAGGCGAATTTCCTCGGGAAGATCTGGCCGTCCCACAAGGGGCGGCCAGGG
AACTTCCTTCAAAACCGGCCAGAGCCGACGGCCCCTCCCGAGCCGACCGCCCCGCCGGCGGAGT
CCTTTCGCTTCGAGGAGACCACGCCCGCCCCCAAGCAAGAGCTCAAGGACCGCGAGCCTCTTAC

Fig. 22 cont'd-33

```
CTCCCTCAAGTCGCTCTTCGGCTCCGACCCGCTTTCGCAAGCGTCGTGATAAGCTAGCGGATCC
GGCGCGC
AscI                                                      NheI
Need re-create XhoI site at the 5' end HV13317 in HV10001 4824bp
AAATGGGGCGCTGAGGTCTGCCTCGTGAAGAAGGTGTTGCTGACTCATACCAGGCCTGAATCG
CCCCATCATCCAGCCAGAAAGTGAGGGAGCCACGGTTGATGAGAGCTTTGTTGTAGGTGGACCA
GTTGGTGATTTTGAACTTTTGCTTTGCCACGGAACGGTCTGCGTTGTCGGGAAGATGCGTGATC
TGATCCTTCAACTCAGCAAAAGTTCGATTTATTCAACAAAGCCGCCGTCCCGTCAAGTCAGCGT
AATGCTCTGCCAGTGTTACAACCAATTAACCAATTCTGCGTTCAAAATGGTATGCGTTTTGACA
CATCCACTATATATCCGTGTCGTTCTGTCCACTCCTGAATCCCATTCCAGAAATTCTCTAGCGA
TTCCAGAAGTTTCTCAGAGTCGGAAAGTTGACCAGACATTACGAACTGGCACAGATGGTCATAA
CCTGAAGGAAGATCTGATTGCTTAACTGCTTCAGTTAAGACCGACGCGCTCGTCGTATAACAGA
TGCGATGATGCAGACCAATCAACATGGCACCTGCCATTGCTACCTGTACAGTCAAGGATGGTAG
AAATGTTGTCGGTCCTTGCACACGAATATTACGCCATTTGCCTGCATATTCAAACAGCTCTTCT
ACGATAAGGGCACAAATCGCATCGTGGAACGTTTGGGCTTCTACCGATTTAGCAGTTTGATACA
CTTTCTCTAAGTATCCACCTGAATCATAAATCGGCAAAATAGAGAAAAATTGACCATGTGTAAG
CGGCCAATCTGATTCCACCTGAGATGCATAATCTAGTAGAATCTCTTCGCTATCAAAATTCACT
TCCACCTTCCACTCACCGGTTGTCCATTCATGGCTGAACTCTGCTTCCTCTGTTGACATGACAC
ACATCATCTCAATATCCGAATACGGACCATCAGTCTGACGACCAAGAGAGCCATAAACACCAAT
AGCCTTAACATCATCCCCATATTTATCCAATATTCGTTCCTTAATTTCATGAACAATCTTCATT
CTTTCTTCTCTAGTCATTATTATTGGTCCGTTCATAACACCCCTTGTATTACTGTTTATGTAAG
CAGACAGTTTTATTGTTCATGATGATATATTTTTATCTTGTGCAATGTAACATCAGAGATTTTG
AGACACAACGTGGCTTTCCCCGGCCCATGACCAAAATCCCTTAACGTGAGTTTTCGTTCCACTG
AGCGTCAGACCCCGTAGAAAAGATCAAAGGATCTTCTTGAGATCCTTTTTTTTCTGCGCGTAATC
TGCTGCTTGCAAACAAAAAAACCACCGCTACCAGCGGTGGTTTGTTTGCCGGATCAAGAGCTAC
CAACTCTTTTTCCGAAGGTAACTGGCTTCAGCAGAGCGCAGATACCAAATACTGTTCTTCTAGT
GTAGCCGTAGTTAGGCCACCACTTCAAGAACTCTGTAGCACCGCCTACATACCTCGCTCTGCTA
ATCCTGTTACCAGTGGCTGCTGCCAGTGGCGATAAGTCGTGTCTTACCGGGTTGGACTCAAGAC
GATAGTTACCGGATAAGGCGCAGCGGTCGGGCTGAACGGGGGGTTCGTGCACACAGCCCAGCTT
GGAGCGAACGACCTACACCGAACTGAGATACCTACAGCGTGAGCTATGAGAAAGCGCCACGCTT
CCCGAAGGGAGAAAGGCGGACAGGTATCCGGTAAGCGGCAGGGTCGGAACAGGAGAGCGCACGA
GGGAGCTTCCAGGGGGAAACGCCTGGTATCTTTATAGTCCTGTCGGGTTTCGCCACCTCTGACT
TGAGCGTCGATTTTTGTGATGCTCGTCAGGGGGCGGAGCCTATGGAAAAACGCCAGCAACGCG
GCCTTTTTACGGTTCCTGGCCTTTTGCTGGCCTTTTGCTCACATGTTCTTTCCTGCGTTATCCC
CTGATTCTGTGGATAACCGTATTACCGCCTTTGAGTGAGCTGATACCGCTCGCCGCAGCCGAAC
GACCGAGCGCAGCGAGTCAGTGAGCGAGGAAGCGGAAGAGCGCCTGATGCGGTATTTTCTCCTT
ACGCATCTGTGCGGTATTTCACACCGCATATGGTGCACTCTCAGTACAATCTGCTCTGATGCCG
CATAGTTAAGCCAGTATCTGCTCCCTGCTTGTGTGTTGGAGGTCGCTGAGTAGTGCGCGAGCAA
AATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCA
TACGTTGTATCTATATCATAATATGTACATTTATATTGGCTCATGTCCAATATGACCGCCATGT
TGACATTGATTATTGACTAGTTATTAATAGTAATCAATTACGGGGTCATTAGTTCATAGCCCAT
ATATGGAGTTCCGCGTTACATAACTTACGGTAAATGGCCCGCCTGGCTGACCGCCCAACGACCC
CCGCCCATTGACGTCAATAATGACGTATGTTCCCATAGTAACGCCAATAGGGACTTTCCATTGA
CGTCAATGGGTGGAGTATTTACGGTAAACTGCCCACTTGGCAGTACATCAAGTGTATCATATGC
CAAGTCCGCCCCCTATTGACGTCAATGACGGTAAATGGCCCGCCTGGCATTATGCCCAGTACAT
GACCTTACGGGACTTTCCTACTTGGCAGTACATCTACGTATTAGTCATCGCTATTACCATGGTG
```

Mosaic and Group M Gag_dmyr-patent.doc

Fig. 22 cont'd-34

```
ATGCGGTTTTGGCAGTACATCAATGGGCGTGGATAGCGGTTTGACTCACGGGGATTTCCAAGTC
TCCACCCCATTGACGTCAATGGGAGTTTGTTTTGGCACCAAAATCAACGGGACTTTCCAAAATG
TCGTAACAACTCCGCCCCATTGACGCAAATGGGCGGTAGGCGTGTACGGTGGGAGGTCTATATA
AGCAGAGCTCGTTTAGTGAACCGTCAGATCGCCTGGAGACGCCATCCACGCTGTTTTGACCTCC
ATAGAAGACACCGGGACCGATCCAGCCTCCGCGGGCGCGCGTCGAGAAGAAAATGGCGGCTCGC
GCCTCGATCCTTCGAGGGGGCAAGTTGGATAAGTGGGAAAAGATCCGCTTGAGGCCAGGAGGGA
AGAAGAGATACATGCTCAAGCACCTGATCTGGGCGAGCAGAGAGCTGGAGCGGTTCGCGCTGAA
CCCGGGCCTGCTTGAGACAGCGGAGGGCTGTCAGCAAATCATCGAGCAGCTTCAAAGCACGCTG
AAGACGGGCAGCGAGGAGCTGAAGTCGCTATTCAACACGGTAGCGACCCTCTACTGCGTGCACC
AGCGGATCGAGGTCAAGGACACGAAGGAGGCTCTTGACAAGGTGGAGGAAGAGCAGAACAAGTC
GAAGAAGAAGGCGCAGCAGGCGGCGGCCGACACCGGCAACTCCTCACAAGTATCTCAGAACTAC
CCGATCGTGCAGAACCTGCAGGGACAGATGGTCCACCAGGCCCTCTCCCACGGACGCTTAACG
CCTGGGTCAAAGTAATCGAGGAGAAGGCCTTCAGCCCGGAAATCATCCCCATGTTCACAGCACT
TTCCGAGGGAGCCACCCCGAGCGACCTGAACACGATGTTGAACACCGTCGGCGGGCACCAGGCG
GCCATGCAGATGCTTAAGGACACCATCAACGAGGAGGCTGCGGAGTGGGACCGGGTGCACCCGG
TGCACGCGGGGCCCATCCCACCGGGCCAGATGAGAGAGCCGCGGGGATCGGACATCGCGGGAAC
CACCAGCAGCTTGCAGGAGCAAATCGCCTGGATGACTTCGAACCCCCGGTCCCGGTCGGGGAG
ATCTACAAGAGATGGATCGTCCTCGGGTTGAACAAGATCGTGAGGATGTACAGCCCTGTGTCAA
TCCTGGACATCCGACAGGGACCGAAGGAGCCCTTCAGAGACTACGTCGACCGGTTCTTCAAGAC
TCTCCGGGCGGAGCAGGCGTCGCAGGACGTCAAGAACTGGATGACGGAGACCTTGTTGGTCCAG
AACGCTAACCCGGACTGCAAGACCATCCTGCGCGCTCTCGGCCCGGGAGCGTCCTTGAAGAGA
TGATGACGGCGTGCCAGGGAGTCGGGGGACCCTCACACAAGGCGCGGGTCTTGGCCGACGCGAT
GAGCCAGACGAACTCCGCCATCCTCATGCAGCGGTCCAACTTCAAGGGAAGCAAGCGGATCGTC
AAGTGTTTCAACTGTGGCAAGGAGGGACACATCGCCAGGAACTGCCGGGCCCCGCGGAAGCGAG
GCTGCTGGAAGTGCGGACAGGAGGGGCACCAAATGAAGGACTGCAACGAGCGCCAGGCGAATTT
CCTCGGGAAGATCTGGCCGTCCCACAAGGGGCGGCCAGGGAACTTCCTTCAAAACCGGCCAGAG
CCGACGGCCCCTCCCGAGCCGACCGCCCCGCCGGCGGAGTCCTTTCGCTTCGAGGAGACCACGC
CCGCCCCCAAGCAAGAGCTCAAGGACCGCGAGCCTCTTACCTCCCTCAAGTCGCTCTTCGGCTC
CGACCCGCTTTCGCAAGCGTCGTGATAAGCTAGCGGATCCGGCGCGCGAGCTCGCTGATCAGCC
TCGACTGTGCCTTCTAGTTGCCAGCCATCTGTTGTTTGCCCCTCCCCCGTGCCTTCCTTGACCC
TGGAAGGTGCCACTCCCACTGTCCTTTCCTAATAAAATGAGGAAATTGCATCGCATTGTCTGAG
TAGGTGTCATTCTATTCTGGGGGGTGGGGTGGGCCAGGACAGCAAGGGGGAGGATTGGGAAGAC
AATAGCAGGCATGCTGGGAATTT
```

Thursday, August 2, 2007
Sequence 2   Length : 4024

| | | 2184 | 2951 | 3180 | 6 Sites | | |
|---|---|---|---|---|---|---|---|
| | | 3249 | 3282 | 3785 | | 3201 | 3600 | 3852 |
| | | 4497 | | | 4074 | 4354 | 4429 |
| | | 4573 | 4594 | | BamHI | GGATCC | |
| AatII | GACGTC | AlwNI | CAGNNNCTG | | 1 Site | | |
| 5 Sites | | 4 Sites | | | 4579 | | |
| 2510 | 2563 | 2646 | 1488 | 2129 | 3471 | BanI | GGYRCC |
| 2032 | 3998 | | 4265 | | | 5 Sites | |
| AccI | GTMKAC | AosII | GRCGYC | | 538 | 2850 | 3638 |
| 1 Site | | 7 Sites | | | 4313 | 4678 | |
| 3950 | | 2507 | 2560 | 2643 | BanII | GRGCYC | |
| AflII | CTTAAG | 2829 | 2983 | 3985 | 6 Sites | | |
| 1 Site | | 3395 | | | 2953 | 3725 | 3835 |
| 3661 | | ApaI | GGGCCC | | 4275 | 4499 | 4556 |
| AflIII | ACRYGT | 2 Sites | | | BclI | TGATCA | |
| 1 Site | | 3725 | 4275 | | 1 Site | | |
| 3897 | | ApaLI | GTGCAC | | 4600 | | |
| AluI | AGCT | 5 Sites | | | BcnI | CCSGG | |
| 16 Sites | | 1583 | 2081 | 3322 | 16 Sites | | |
| 109 | 633 | 1340 | 3703 | 3712 | | 1373 | 1521 | 3021 |
| 1597 | 1643 | 1733 | AsuII | TTCGAA | | 3203 | 3204 | 3557 |
| 1959 | | 1 Site | | | 3701 | | |
| | | 3814 | | | | | |
| | | AvaI | CYCGRG | | | | |

Mosaic and Group M Gag_dnyr-patent.doc

Fig. 22 cont'd-35

```
      3710      3735      3824              4602                              1587      2085      2953
3830      3974      4043            DraIII    CACNNNGTG             3326      3707      3716
4076                                2 Sites                         4499
      4077      4271                      1161      3711                  4596
BglI      GCCNNNNNGGC               Eco47I    GGWCC                 HhaI      GCGC
4 Sites                             13 Sites                        22 Sites
      2475      2597      2668            122       586       919         11        496       1273
4447                                1048      3021      3485       1382      1556      1656
BglII     AGATCT                    3695                            1723
3 Sites                                   3824      3921      4026        1993      2026      2169
      458       3839      4361      4122      4192      4502       2249      3045      3047
Bsp1286   GDGCHC                    EcoO109   RGGNCCY               3073
14 Sites                            4 Sites                               3195      3405      4064
      652       1587      2085            3495      3721      4123  4066      4140      4340
2953      3326      3541            4272                            4588
3707                                EcoRII    CCWGG                       4590
      3716      3725      3935      18 Sites                        HincII    GTYRAC
4275      4316      4499                  50        1736      1749  4 Sites
4596                                1870      2473      2666              413       886       2369
BspHI     TCATGA                    2975                            3951
2 Sites                                   3126      3491      3520  HinfI     GANTC
      1007      1105                3641      3802      3905        16 Sites
BspNI     CCWGG                     4109                                  43        59        357
18 Sites                                  4258      4340      4386  383       401       725       779
      52        1738      1751      4670                                  807       1527      1923
1872      2475      2668            EcoRV     GATATC                1998      2222      2795
2977                                1 Site                          3965
      3128      3493      3522            2294                            4115      4453
3643      3804      3907             Fnu4HI    GCNGC                HinPI     GCGC
4111                                28 Sites                        22 Sites
      4260      4342      4388            234       769       1283        9         494       1271
4672                                1489      1492      1557       1380      1554      1654
BssHII    GCGCGC                    1700                            1721
3 Sites                                   1555      1973      1976        1991      2024      2167
      3045      4064      4588      1994      2110      2250       2247      3043      3045
BstNI     CCWGG                     2279                            3071
18 Sites                                  2282      3065      3247        3193      3403      4062
      52        1738      1751      3273      3406      3413       4064      4138      4338
1872      2475      2668            3416                            4386
2977                                      3647      3686      3751        4588
      3128      3493      3522      3783      4189      4290       HpaII     CCGG
3643      3804      3907            4384                            23 Sites
4111                                FnuDII    CGCG                        848       1172      1329
      4260      4342      4388      21 Sites                        1519      1545      1692
4672                                      494       1273      1854  3019
Cfr10I    RCCGGY                    2169      2257      2281              3202      3425      3556
5 Sites                             2445                            3699      3709      3733
      847       3424      3953            3039      3045      3047  3823
4406      4446                      3071      3193      3718             3829      3954      3972
CfrI      YGGCCR                    3753                            4042      4075      4269
7 Sites                                   3769      4064      4140  4407
      769       3416      3647      4278      4508      4588              4447      4583
4148      4366      4384            4590                            MaeI      CTAG
4409                                HaeII     RGCGCY                7 Sites
ClaI      ATCGAT                    4 Sites                               378       801       1034
1 Site                                    12        1657      2027  1404      2389      4574
      2287                          4341                            4622
DdeI      CTNAG                     HaeIII    GGCC                  MaeII     ACGT
12 Sites                            25 Sites                        12 Sites
      12        204       397             55        771       1175        669       1360      1196
711       787       1214      1623  1423      1857      1875       2306      2507      2519
2088      2158      2229            1886                            2560
3446      4732                            2268      2469      2662        2643      2724      2829
DpnI      GATC                      3126      3206      3418       3947      3995
22 Sites                            3496                            MaeIII    GTNAC
      190       195       460             3547      3649      3723  8 Sites
1239      1247      1258            3737      4073      4150              270       1134      1361
1333                                4273                            1477      1540      2446
      2972      3028      3079            4368      4386      4410  2533
3115      3163      3334            4423                            2882
3460                                HgiAI     GWGCWC                MvaI      CCNGG
      3755      3841      3856      8 Sites                         34 Sites
3877      4215      4363
4581
Mosaic and Group M Gag_dmyr-patent.doc
```

Fig. 22 cont'd-36

```
        52    1172    1520           1314    1559    2281           3823    3829    3907
  1738    1751    1872            3039    3220    3530            3973    4042    4075
2475                              3753                             4076
  2668    2977    3020              4191    4278                     4111    4260    4270
3128    3202    3203            PpuMI    RGGWCCY                  4342    4368    4672
3493                            1 Site                            SdnI     GDGCHC
  3522    3556    3643              4123                          14 Sites
3700    3709    3734            RsaI     RGGNCCY                     652    1587    2085
3804                            4 Sites                           2953    3326    3641
  3823    3829    3907              3498    3724    4128          3707
3973    4042    4075            4275                                 3716    3725    3935
4076                            PstI     CTGCAG                   4275    4316    4499
  4111    4260    4270          1 Site                            4596
4342    4368    4672               3476                           SinI     GGWCC
NaeI     GCCGGC                 PvuI     CGATCG                   13 Sites
1 Site                          1 Site                               123     587     920
   4448                            3461                           1049    1022    3486
NciI     CCSGG                  RsaI     GTAC                     3696
16 Sites                        10 Sites                             3825    3922    4026
  1172    1520    3020              559    2093    2263           4123    4193    4503
3202    3203    3556            2330    2604    2684              SmaI     CCCGGG
3700                            2717                              2 Sites
  3709    3734    3823              2768    2925    3885             3203    4076
3829    3973    4042            SacI     GAGCTC                   SnaBI    TACGTA
4075                            3 Sites                           1 Site
   4076    4270                    2953    4499    4596              2725
NcoI     CCATGG                 SacII    CCGCGG                   SpeI     ACTAGT
1 Site                          4 Sites                           1 Site
   2745                            2282    3040    3754              2384
NdeI     CATATG                 4279                              SphI     GCATGC
2 Sites                         SalI     GTCGAC                   1 Site
  2076    2619                  1 Site                               4813
NheI     GCTAGC                    3949                           SspI     AATATT
1 Site                          Sau3A    GATC                     2 Sites
   4573                         22 Sites                             603     991
NlaIII   CATG                      188     193     458            StuI     AGGCCT
18 Sites                        1237    1245    1255              2 Sites
   538     762     864          1331                                  55    3547
  892    1011    1109    1131      2970    3026    3077           StyI     CCWWGG
  1901    2219    2349          3113    3161    3332              2 Sites
  2367    2689    2749          3458                                 2745    4035
3150                               3757    3839    3854           TaqI     TCGA
  3573    3654    4188          3875    4217    4361              14 Sites
4813                            4579                                  216    1799    2287
NlaIV    GGNNCC                    4600                           3050    3076    3084
24 Sites                        Sau96A   GGNCC                    3242
    92     540    1830          26 Sites                             3335    3391    3536
1869    2852    3023               123     587     920            3814    3950    4466
3594                            1049    1174    2266              4609
  3640    3697    3722          2468                              Tth111I  GACNNNGTC
3723    3774    3827               2561    3022    3204           1 Site
3923                            3486    3495    3696                 3946
  3932    4124    4125          3721                              XhoII    RGATCY
4273    4274    4315               3722    3735    3825           7 Sites
4424                            3922    4025    4072                 458    1245    1256
  4542    4581    4680          4123                              3113    3839    4361
NruI     TCGCGA                    4193    4271    4272           4579
1 Site                          4422    4503                      XmaI     CCCGGG
   2257                         ScrFI    CCNGG                    2 Sites
NsiI     ATGCAT                 34 Sites                             3203    4074
1 Site                              52    1172    1520            XmaIII   CGGCCG
    796                         1738    1751    1872              1 Site
Nsp7524I RCATGY                 2475                                 3416
3 Sites                            2668    2977    3020           XmnI     GAANNNNTTC
  1901    3150    4313          3128    3202    3203              2 Sites
NspBII   CMGCKG                 3493                                 811    3547
9 Sites                            3522    3556    3643
                                3700    3709    3734
                                3804
```

Fig. 22 cont'd-37

Gag_M4.4 Dmyr
MAARASVLRGEKLDKWERIRLRPGGKKHYMLKHLVWASRELEKFALNPGLLETSEGCKQIIKQL
QPALQTGTEELRSLFNTVATLYCVHAGIEVRDTKEALDKIEEIQNKSKQKTQQAAAGTGSSSKV
SQNYPIVQNLQGQMVHQPLSPRTLNAWVKVVEEKGFNPEVIPMFSALSEGATPQDLNMMLNIVG
GHQAAMQMLKETINEEAAEWDRLHPVHAGPIAPGQMREPRGSDIAGSTSTLQEQIAWMTGNPPV
PVGDIYKRWIILGLNKIVKMYSPTSILDIKQGPKEPFRDYVDRFYKTLRAEQATQEVKNWMTDT
LLVQNANPDCKSILKALGTGATLEEMMSACQGVGGPAHKARVLAEAMSQANNTNIMMQRSNFKG
PKRIIKCFNCGKEGHIAKNCRAPRKKGCWKCGKEGHQMKDCTERQANFLGRIWPSSKGRPGNFL
QSRPEPTAPPAEPTAPPAESFKFEETTPAPKQEPKDREPLTSLRSLFGSDPLLQAS

HV13318 (Gag_M4.4 Dmyr.wlv)
GTCGAGAAGAAA<u>ATG</u>GCGGCTCGCGCCTCGGTCCTTCGAGGGGAGAAGTTGGATAAGTGGGAAC
GGATCCGCTTGAGGCCAGGAGGGAAGAAGCACTACATGCTCAAGCACCTGGTCTGGGCGAGCAG
AGAGCTGGAGAAGTTCGCGCTGAACCCGGGCCTGCTTGAGACATCCGAGGGCTGTAAGCAAATC
ATCAAGCAGCTTCAACCAGCGCTCCAGACGGGCACCGAGGAGCTGCGCTCGCTATTCAACACGG
TAGCGACCCTCTACTGCGTGCACGCCGGAATCGAAGTTCGTGACACGAAGGAGGCTCTTGACAA
GATCGAGGAAATCCAGAACAAGTCGAAGCAGAAGACCCAGCAGGCGGCGGCCGGGACCGGCTCG
TCCTCAAAAGTATCTCAGAACTACCCGATCGTGCAGAACCTGCAGGGACAGATGGTCCACCAGC
CGCTCTCCCCACGGACGCTTAACGCCTGGGTCAAAGTAGTCGAGGAGAAGGGGTTCAACCCGGA
AGTCATCCCCATGTTCTCGGCACTTTCCGAGGGAGCCACCCCGCAGGACCTGAACATGATGTTG
AACATCGTCGGCGGGCACCAGGCGGCCATGCAGATGCTTAAGGAGACCATCAACGAGGAGGCTG
CGGAGTGGGACCGCCTGCACCCGGTGCACGCGGGGCCCATCGCACCGGGCCAGATGAGAGAGCC
GCGGGGATCGGACATCGCGGGATCCACCAGCACCTTGCAGGAGCAAATCGCCTGGATGACTGGG
AACCCCCCGGTCCCGGTCGGGGACATCTACAAGAGATGGATCATCCTCGGGTTGAACAAGATCG
TGAAGATGTACAGCCCTACGTCAATCCTGGACATCAAGCAGGGCCCCAAGGAGCCCTTCAGAGA
CTACGTCGACCGGTTCTACAAGACTCTCCGGGCGGAGCAGGCGACGCAGGAGGTCAAGAACTGG
ATGACGGACACCTTGTTGGTCCAGAACGCTAACCCGGACTGCAAGAGCATCCTGAAGGCTCTCG
GCACGGGAGCGACCTTGGAAGAGATGATGTCCGCGTGCCAGGGAGTCGGGGGACCCGCGCACAA
GGCGCGGGTCTTGGCCGAGGCGATGTCCCAGGCCAACAACACGAACATCATGATGCAGCGGTCC
AACTTCAAGGGACCGAAGCGGATCATCAAGTGTTTCAACTGTGGCAAGGAGGGACACATCGCCA
AGAACTGCCGGGCCCCGCGGAAGAAGGGCTGCTGGAAGTGCGGAAAGGAGGGGCACCAAATGAA
GGACTGCACGGAGCGCCAGGCGAATTTCCTCGGGCGGATCTGGCCGTCCTCGAAGGGGCGGCCA
GGGAACTTCCTTCAATCGCGGCCAGAGCCGACGGCCCCTCCCGCGGAGCCGACCGCCCCGCCGG
CGGAGTCCTTTAAGTTCGAGGAGACCACGCCCGCCCCAAGCAAGAGCCGAAGGACCGCGAGCC
TCTTACCTCCCTCCGGTCGCTCTTCGGCTCCGACCCGCTTCTGCAAGCGTCG<u>TGATAA</u>GCTAGC
GGATCCGGCGCGCC                                                  NheI
    AscI

HV13318 in in HV10001 4831bp
AAATGGGGCGCTGAGGTCTGCCTCGTGAAGAAGGTGTTGCTGACTCATACCAGGCCTGAATCG
CCCCATCATCCAGCCAGAAAGTGAGGGAGCCACGGTTGATGAGAGCTTTGTTGTAGGTGGACCA
GTTGGTGATTTTGAACTTTTGCTTTGCCACGGAACGGTCTGCGTTGTCGGGAAGATGCGTGATC
TGATCCTTCAACTCAGCAAAAGTTCGATTTATTCAACAAAGCCGCCGTCCCGTCAAGTCAGCGT
AATGCTCTGCCAGTGTTACAACCAATTAACCAATTCTGCGTTCAAAATGGTATGCGTTTTGACA
CATCCACTATATATCCGTGTCGTTCTGTCCACTCCTGAATCCCATTCCAGAAATTCTCTAGCGA
TTCCAGAAGTTTCTCAGAGTCGGAAAGTTGACCAGACATTACGAACTGGCACAGATGGTCATAA
CCTGAAGGAAGATCTGATTGCTTAACTGCTTCAGTTAAGACCGACGCGCTCGTCGTATAACAGA
TGCGATGATGCAGACCAATCAACATGGCACCTGCCATTGCTACCTGTACAGTCAAGGATGGTAG
AAATGTTGTCGGTCCTTGCACACGAATATTACGCCATTTGCCTGCATATTCAAACAGCTCTTCT

Mosaic and Group M Gag_dmyr-patent.doc

Fig. 22 cont'd-38

```
ACGATAAGGGCACAAATCGCATCGTGGAACGTTTGGGCTTCTACCGATTTAGCAGTTTGATACA
CTTTCTCTAAGTATCCACCTGAATCATAAATCGGCAAAATAGAGAAAAATTGACCATGTGTAAG
CGGCCAATCTGATTCCACCTGAGATGCATAATCTAGTAGAATCTCTTCGCTATCAAAATTCACT
TCCACCTTCCACTCACCGGTTGTCCATTCATGGCTGAACTCTGCTTCCTCTGTTGACATGACAC
ACATCATCTCAATATCCGAATACGGACCATCAGTCTGACGACCAAGAGAGCCATAAACACCAAT
AGCCTTAACATCATCCCCATATTTATCCAATATTCGTTCCTTAATTTCATGAACAATCTTCATT
CTTTCTTCTAGTCATTATTATTGGTCCGTTCATAACACCCCTTGTATTACTGTTTATGTAAG
CAGACAGTTTTATTGTTCATGATGATATATTTTATCTTGTGCAATGTAACATCAGAGATTTTG
AGACACAACGTGGCTTTCCCCGGCCCATGACCAAAATCCCTTAACGTGAGTTTTCGTTCCACTG
AGCGTCAGACCCCGTAGAAAAGATCAAAGGATCTTCTTGAGATCCTTTTTTTCTGCGCGTAATC
TGCTGCTTGCAAACAAAAAAACCACCGCTACCAGCGGTGGTTTGTTTGCCGGATCAAGAGCTAC
CAACTCTTTTTCCGAAGGTAACTGGCTTCAGCAGAGCGCAGATACCAAATACTGTTCTTCTAGT
GTAGCCGTAGTTAGGCCACCACTTCAAGAACTCTGTAGCACCGCCTACATACCTCGCTCTGCTA
ATCCTGTTACCAGTGGCTGCTGCCAGTGGCGATAAGTCGTGTCTTACCGGGTTGGACTCAAGAC
GATAGTTACCGGATAAGGCGCAGCGGTCGGGCTGAACGGGGGGTTCGTGCACACAGCCCAGCTT
GGAGCGAACGACCTACACCGAACTGAGATACCTACAGCGTGAGCTATGAGAAAGCGCCACGCTT
CCCGAAGGGAGAAAGGCGGACAGGTATCCGGTAAGCGGCAGGGTCGGAACAGGAGAGCGCACGA
GGGAGCTTCCAGGGGGAAACGCCTGGTATCTTTATAGTCCTGTCGGGTTTCGCCACCTCTGACT
TGAGCGTCGATTTTTGTGATGCTCGTCAGGGGGCGGAGCCTATGGAAAAACGCCAGCAACCCG
GCCTTTTTACGGTTCCTGGCCTTTTGCTGGCCTTTTGCTCACATGTTCTTTCCTGCGTTATCCC
CTGATTCTGTGGATAACCGTATTACCGCCTTTGAGTGAGCTGATACCGCTCGCCGCAGCCGAAC
GACCGAGCGCAGCGAGTCAGTGAGCGAGGAAGCGGAAGAGCGCCTGATGCGGTATTTTCTCCTT
ACGCATCTGTGCGGTATTTCACACCGCATATGGTGCACTCTCAGTACAATCTGCTCTGATGCCC
CATAGTTAAGCCAGTATCTGCTCCCTGCTTGTGTGTTGGAGGTCGCTGAGTAGTGCGCGAGCAA
AATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCA
TACGTTGTATCTATATCATAATATGTACATTTATATTGGCTCATGTCCAATATGACCGCCATGT
TGACATTGATTATTGACTAGTTATTAATAGTAATCAATTACGGGGTCATTAGTTCATAGCCCAT
ATATGGAGTTCCGCGTTACATAACTTACGGTAAATGGCCCGCCTGGCTGACCGCCCAACGACCC
CCGCCCATTGACGTCAATAATGACGTATGTTCCCATAGTAACGCCAATAGGGACTTTCCATTGA
CGTCAATGGGTGGAGTATTTACGGTAAACTGCCCACTTGGCAGTACATCAAGTGTATCATATGC
CAAGTCCGCCCCCTATTGACGTCAATGACGGTAAATGGCCCGCCTGGCATTATGCCCAGTACAT
GACCTTACGGGACTTTCCTACTTGGCAGTACATCTACGTATTAGTCATCGCTATTACCATGGTG
ATGCGGTTTTGGCAGTACATCAATGGGCGTGGATAGCGGTTTGACTCACGGGGATTTCCAAGTC
TCCACCCCATTGACGTCAATGGGAGTTTGTTTTGGCACCAAAATCAACGGGACTTTCCAAAATG
TCGTAACAACTCCGCCCCATTGACGCAAATGGGCGGTAGGCGTGTACGGTGGGAGGTCTATATA
AGCAGAGCTCGTTTAGTGAACCGTCAGATCGCCTGGAGACGCCATCCACGCTGTTTTGACCTCC
ATAGAAGACACCGGGACCGATCCAGCCTCCGCGGGCGCGCGTCGAGAAGAAATGGCGGCTCGC
GCCTCGGTCCTTCGAGGGGAGAAGTTGATAAGTGGGAACGGATCCGCTTGAGGCCAGGAGGGA
AGAAGCACTACATGCTCAAGCACCTGGTCTGGGCGAGCAGAGAGCTGGAGAAGTTCGCGCTGAA
CCCGGGCCTGCTTGAGACATCCGAGGGCTGTAAGCAAATCATCAAGCAGCTTCAACCAGCGCTC
CAGACGGGCACCGAGGAGCTGCGCTCGCTATTCAACACGGTAGCGACCCTCTACTGCGTGCACC
CCGGAATCGAAGTTCGTGACACGAAGGAGGCTCTTGACAAGATCGAGGAAATCCACAACAAGTC
GAAGCAGAAGACCCAGCAGGCGGCGGCCGGGACCGGCTCGTCCTCAAAAGTATCTCAGAACTAC
CCGATCGTGCAGAACCTGCAGGGACAGATGGTCCACCAGCCGCTCTCCCACGGACGCTTAACC
CCTGGGTCAAAGTAGTCGAGGAGAAGGGGTTCAACCCGGAAGTCATCCCCATGTTCTCGCCACT
TTCCGAGGGAGCCACCCCGCAGGACCTGAACATGATGTTGAACATCGTCGGCGGGCACCAGGCG
GCCATGCAGATGCTTAAGGAGACCATCAACGAGGAGGCTGCGGAGTGGGACCGCCTGCACCCGG
TGCACGCGGGCCCATCGCACCGGGCCAGATGAGAGAGCCGCGGGGATCGGACATCGCGGGATC
```

Mosaic and Group M Gag_dnyr-patent.doc

```
CACCAGCACCTTGCAGGAGCAAATCGCCTGGATGACTGGGAACCCCCCGGTCCCGGTCGGGGAC
ATCTACAAGAGATGGATCATCCTCGGGTTGAACAAGATCGTGAAGATGTACAGCCCTACGTCAA
TCCTGGACATCAAGCAGGGCCCCAAGGAGCCCTTCAGAGACTACGTCGACCGGTTCTACAAGAC
TCTCCGGGCGGAGCAGGCGACGCAGGAGGTCAAGAACTGGATGACGGACACCTTGTTGGTCCAG
AACGCTAACCCGGACTGCAAGAGCATCCTGAAGGCTCTCGGCACGGGAGCGACCTTGGAAGAGA
TGATGTCCGCGTGCCAGGGAGTCGGGGACCCGCGCACAAGGCGCGGGTCTTGGCCGAGGCGAT
GTCCCAGGCCAACAACACGAACATCATGATGCAGCGGTCCAACTTCAAGGGACCGAAGCGGATC
ATCAAGTGTTTCAACTGTGGCAAGGAGGGACACATCGCCAAGAACTGCCGGGCCCCGCGGAAGA
AGGGCTGCTGGAAGTGCGGAAAGGAGGGGCACCAAATGAAGGACTGCACGGAGCGCCAGGCGAA
TTTCCTCGGGCGGATCTGGCCGTCCTCGAAGGGGCGGCCAGGGAACTTCCTTCAATCGCGGCCA
GAGCCGACGGCCCCTCCCGCGGAGCCGACCGCCCCGCCGGCGGAGTCCTTTAAGTTCGAGGAGA
CCACGCCCGCCCCAAGCAAGAGCCGAAGGACCGCGAGCCTCTTACCTCCCTCCGGTCGCTCTT
CGGCTCCGACCCGCTTCTGCAAGCGTCGTGATAAGCTAGCGGATCCGGCGCGCCGAGCTCGCTG
ATCAGCCTCGACTGTGCCTTCTAGTTCCAGCCATCTGTTGTTTGCCCCTCCCCCGTGCCTTCC
TTGACCCTGGAAGGTGCCACTCCCACTGTCCTTTCCTAATAAAATGAGGAAATTGCATCGCATT
GTCTGAGTAGGTGTCATTCTATTCTGGGGGGTGGGGTGGGGCAGGACAGCAAGGGGAGGATTG
GGAAGACAATAGCAGGCATGCTGGGAATTT
```

Primers:

HV1001-F2892
CCGCCCCATTGACGCAAATGG

HV1001-R3113
GCTGGCAACTAGAAGGCACAG
(+ strand: CTGTGCCTTCTAGTTGCCAGC

Thursday, August 2, 2007

Sequence 4    Length : 4831

| | | | | |
|---|---|---|---|---|
| AatII | GACGTC | | | |
| 4 Sites | | | | |
| 2510 | 2563 | 2646 | | |
| 2832 | | | | |
| AccI | GTMKAC | | | |
| 1 Site | | | | |
| 3950 | | | | |
| AflII | CTTAAG | | | |
| 1 Site | | | | |
| 3661 | | | | |
| AflIII | ACRYGT | | | |
| 1 Site | | | | |
| 1897 | | | | |
| AluI | AGCT | | | |
| 14 Sites | | | | |
| 109 | 633 | 1340 | | |
| 1597 | 1643 | 1733 | | |
| 1959 | | | | |
| 2184 | 2951 | 3180 | | |
| 3249 | 3282 | 4579 | | |
| 4601 | | | | |
| AlwNI | CAGNNNCTG | | | |
| 4 Sites | | | | |
| 1488 | 2129 | 3471 | | |
| 3609 | | | | |
| AosII | GRCGYC | | | |
| 5 Sites | | | | |
| 2507 | 2560 | 2643 | | |
| 2829 | 2983 | | | |
| ApaI | GGGCCC | | | |
| 3 Sites | | | | |

| | | | |
|---|---|---|---|
| ApaLI | GTGCAC | | |
| 4 Sites | | | |
| 1583 | 2083 | 3322 | |
| 3712 | | | |
| AvaI | CYCGRG | | |
| 3 Sites | | | |
| 3201 | 3862 | 4357 | |
| BamHI | GGATCC | | |
| 3 Sites | | | |
| 3113 | 3772 | 4585 | |
| BanI | GGYRCC | | |
| 6 Sites | | | |
| 538 | 2850 | 3271 | |
| 3638 | 4316 | 4685 | |
| BanII | GRGCYC | | |
| 6 Sites | | | |
| 2953 | 3725 | 3925 | |
| 3935 | 4279 | 4603 | |
| BclI | TGATCA | | |
| 1 Site | | | |
| 4607 | | | |
| BcnI | CCSGG | | |
| 14 Sites | | | |
| 1173 | 1521 | 3021 | |
| 3203 | 3204 | 3421 | |
| 3557 | | | |
| 3710 | 3735 | 3824 | |
| 3830 | 3974 | 4043 | |
| 4274 | | | |
| BglI | GCCNNNNNGGC | | |
| 4 Sites | | | |
| 2475 | 2597 | 2668 | |
| 4453 | | | |

| | | | |
|---|---|---|---|
| BglII | AGATCT | | |
| 1 Site | | | |
| 458 | | | |
| Bsp1286 | GDGCHC | | |
| 14 Sites | | | |
| 652 | 1587 | 2085 | |
| 2953 | 3274 | 3326 | |
| 3641 | | | |
| 3716 | 3725 | 3925 | |
| 3935 | 4279 | 4319 | |
| 4603 | | | |
| BspHI | TCATGA | | |
| 3 Sites | | | |
| 1007 | 1105 | 4184 | |
| BspNI | CCWGG | | |
| 18 Sites | | | |
| 52 | 1738 | 1751 | |
| 1872 | 2475 | 2666 | |
| 2977 | | | |
| 3128 | 3160 | 3522 | |
| 3643 | 3804 | 3907 | |
| 4111 | | | |
| 4165 | 4345 | 4391 | |
| 4679 | | | |
| BssHII | GCGCGC | | |
| 2 Sites | | | |
| 3045 | 4594 | | |
| BstNI | CCWGG | | |
| 18 Sites | | | |
| 52 | 1738 | 1751 | |
| 1872 | 2475 | 2658 | |
| 2977 | | | |

Mosaic and Group M Gag_dmyr-patent.doc

Fig. 22 cont'd-40

```
            3128     3160     3522         2282     3065     3247    HpaII    CCGG
3643     3804     3907             3283     3413     3416             25 Sites
4111                                3496                                      848     1172     1329
   4165     4345     4391              3647     3686     3751         1019     1545     1692
4679                                4192     4293     4387            3019
CfrI0I    RCCGGY                    4411                                      3202     3329     3419
4 Sites                             FnuDII    CGCG                    3425     3556     3709
         847     3424     3953      23 Sites                          3733
4452                                         494     1273     1854            3823     3829     3954
CfrI      YGGCCR                    2169     2257     2281            3972     4042     4272
7 Sites                             2445                              4453
         769     3416     3647              3039     3045     3047            4533     4589
4148     4369     4387              3071     3193     3718            MaeI     CTAG
4411                                3753                              7 Sites
ClaI      ATCGAT                             3769     4105     4129           378     801     1034
1 Site                              4140     4281     4410            1404     2385     4580
         2287                       4435                              4629
DdeI      CTNAG                              4514     4594            MaeII    ACGT
12 Sites                            HaeII    RGCGCY                   12 Sites
          12     204     397        5 Sites                                    669     1160     1196
711     787     1214     1623               12     1657     2027      2306     2507     2519
2088     2158     2229              3262     4344                     2560
3446     4739                       HaeIII   GGCC                              2643     2724     2829
DpnI      GATC                      24 Sites                          3898     3947
20 Sites                                     55     771     1175      MaeIII   GTNAC
         190     195     460        1423     1857     1875            9 Sites
1239     1247     1258              1886                                       270     1134     1361
1333                                         2268     2469     2662   1477     1540     2446
          2972     3028     3115    3126     3206     3418            2533
3370     3400     3759              3649                                       2882     3343
3774                                         3723     3737     3923   MvaI     CCNGG
          3856     3877     4222    4150     4168     4276            32 Sites
4366     4507     4609              4371                                        52     1172     1520
DraIII    CACNNNGTG                          4389     4413     4426   1738     1751     1872
2 Sites                             HgiAI    GWGCWC                   2475
         1161     3711              6 Sites                                    2658     2977     3020
Eco47I    GGWCC                              1587     2085     2953   3128     3160     3202
16 Sites                            3326     3716     4603            3203
         122     586     919        HhaI     GCGC                              3420     3522     3556
1048     3021     3077              22 Sites                          3643     3709     3734
3421                                          11     496     1273    3804
         3485     3605     3695     1382     1555     1656                    3823     3829     3907
3824     4025     4122              1723                              3973     4042     4111
4135                                          1993     2026     2169  4165
          4209     4508              2249     3045     3047                    4273     4345     4391
Eco47III  AGCGCT                    3073                              4679
1 Site                                        3195     3261     3287  NaeI     GCCGGC
         3260                       4133     4149     4343            1 Site
EcoO109   RGGNCCY                   4594                                       4454
6 Sites                             4596                              NciI     CCSGG
         3606     3721     3921     HincII   GTYRAC                   14 Sites
3922     4123     4275              4 Sites                                    1172     1520     3020
EcoRII    CCWGG                              413     886     2369     3202     3203     3420
18 Sites                            3951                              3556
          50     1736     1749      HinfI    GANTC                             3709     3734     3823
1870     2473     2666              17 Sites                          3829     3973     4042
2975                                          43      59     357      4273
          3126     3158     3520    383     401     725     779      NcoI     CCATGG
3641     3802     3905                       807     1527     1923   1 Site
4109                                1998     2222     2795                    2745
          4163     4343     4389    3332                              NdeI     CATATG
4677                                         3956     4115     4459  2 Sites
EcoRV     GATATC                    HinPI    GCGC                              2076     2619
1 Site                              22 Sites                          NheI     GCTAGC
         2294                                 9     494     2271      1 Site
Fnu4HI    GCNGC                     1380     1554     1654                     4579
28 Sites                            1721                              NlaIII   CATG
         234     769     1263                1991     2024     2167  15 Sites
1489     1492     1587              2247     3043     3045                    538     762     804
1700                                3071                              892     1011     1109     1181
          1855     1973     1976             3193     3259     3285   1901     2219     2349
1994     2210     2250              4129     4138     4341            2367     2689     2749
2273                                4592                              3150
                                    4594
```

Mosaic and Group M Gag_dmyr-patent.doc

Fig. 22 cont'd-41

```
             3573    3618    3654      1 Site                    4210    4509
4188    4820                            3949                   SmaI    CCCGGG
NlaIV   GGNNCC                        Sau3A    GATC            1 Site
31 Sites                              20 Sites                   3203
          92     540    1830                188     193    458 SnaBI   TACGTA
1659    2852    3023                  1237    1245    1256     1 Site
3115                                  1331                       2725
        3273    3423    3594                2970    3026   3113 SpeI    ACTAGT
3640    3697    3722                  3368    3458    3757     1 Site
3723                                  3772                       2384
        3774    3817    3827                3854    3975   4220 SphI    GCATGC
3923    3924    3932                  4364    4585    4607     1 Site
4124                                  Sau96A   GGNCC              4820
        4125    4211    4276          29 Sites                 SspI    AATATT
4277    4318    4427                        123     587    920 2 Sites
4439                                  1049    1174    2266          603     991
        4548    4587    4687          2468                     StuI    AGGCCT
NruI    TCGCGA                              2601    3022   3078 1 Site
1 Site                                3204    3422    3486           55
        2257                          3606                     StyI    CCWWGG
NsiI    ATGCAT                              3696    3721   3722 3 Sites
1 Site                                3735    3825    3921        2745    3926    4085
         796                          3922                     TaqI    TCGA
Nsp7524I  RCATGY                            4026    4123   4196 13 Sites
3 Sites                               4210    4274    4275         216    1799    2287
        1901    3150    4820          4425                     3050    3084    3335
NspBII  CMGCKG                        ScrFI    CCNGG           3371
8 Sites                               32 Sites                       3391    3536    3950
        1314    1559    2281                 52    1172   1520 4378    4472    4616
3039    3753    4194                  1738    1751    1872     Tth111I  CACNNNGTC
4281                                  2475                     1 Site
        4435                                2668    2977   3020        3946
PpuMI   RGGWCCY                       3128    3160    3202     XhoII   RGATCY
2 Sites                               3203                     7 Sites
        3606    4123                        3420    3522   3556       458    1245    1255
PssI    RGGNCCY                       3643    3709    3734     3113    3772    4364
6 Sites                               3804                     4585
        3609    3724    3924                3823    3829   3907 XmaI    CCCGGG
3925    4126    4278                  3973    4042    4111     1 Site
PstI    CTGCAG                        4165                       3201
1 Site                                      4273    4345   4391 XmaIII  CGGCCG
        3476                          4679                     1 Site
PvuI    CGATCG                        SdnI    GDGCHC             3416
1 Site                                14 Sites                 XmnI    GAANNKNTTC
        3461                                 652    1587   2085 2 Sites
RsaI    GTAC                          2953    3274    3326          811    3547
10 Sites                              3641
         559    2093    2263                3716    3725   3925 Following enzymes have no
2330    2604    2684                  3935    4278    4319     sites
2717                                  4603                     AccIII   Asp718   AsuII
        2768    2925    3889          SinI    GGWCC            AvrII    BalI     BbeI
SacI    GAGCTC                        16 Sites                 BspMII   BstEII   BstXI
2 Sites                                     123     587    920 DraI     EcoRI    EspI
        2953    4603                  1049    3022    3078     FspI     HindIII  HpaI
SacII   CCGCGG                        3422                     KpnI     MluI     MstI
5 Sites                                     3486    3606   3696 NarI     NotI     OxaNI
        2282    3040    3754          3825    4026    4123     PflMI    PvuII    RsrII
4282    4436                          4196                     ScaI     SfiI     SplI
SalI    GTCGAC                                                 XbaI     XcaI     XhoI
```

Primer below can be used for Gag-M4.1 through 4.4 to generate XhoI site:

Gag-M2-4-fG/C:  GGGCGCCTCGAGAAGAAAATGGCGGCTCG

WLV001AM (vector sequence), hv10001
AAATGGGGGCGCTGAGGTCTGCCTCGTGAAGAAGGTGTTGCTGACTCATACCAGGCCTGAATCG
CCCCATCATCCAGCCAGAAAGTGAGGGAGCCACGGTTGATGAGAGCTTTGTTGTAGGTGGACCA Mosaic and Group M Gag_dmyr-patent.doc

Fig. 22 cont'd-42

```
GTTGGTGATTTTGAACTTTTGCTTTGCCACGGAACGGTCTGCGTTGTCGGGAAGATGCGTGATC
TGATCCTTCAACTCAGCAAAAGTTCGATTTATTCAACAAAGCCGCCGTCCCGTCAAGTCAGCGT
AATGCTCTGCCAGTGTTACAACCAATTAACCAATTCTGCGTTCAAAATGGTATGCGTTTTGACA
CATCCACTATATATCCGTGTCGTTCTGTCCACTCCTGAATCCCATTCCAGAAATTCTCTAGCGA
TTCCAGAAGTTTCTCAGAGTCGGAAAGTTGACCAGACATTACGAACTGGCACAGATGGTCATAA
CCTGAAGGAAGATCTGATTGCTTAACTGCTTCAGTTAAGACCGACGCGCTCGTCGTATAACAGA
TGCGATGATGCAGACCAATCAACATGGCACCTGCCATTGCTACCTGTACAGTCAAGGATGGTAG
AAATGTTGTCGGTCCTTGCACACGAATATTACGCCATTTGCCTGCATATTCAAACAGCTCTTCT
ACGATAAGGGCACAAATCGCATCGTGGAACGTTTGGGCTTCTACCGATTTAGCAGTTTGATACA
CTTTCTCTAAGTATCCACCTGAATCATAAATCGGCAAAATAGAGAAAAATTGACCATGTGTAAG
CGGCCAATCTGATTCCACCTGAGATGCATAATCTAGTAGAATCTCTTCGCTATCAAAATTCACT
TCCACCTTCCACTCACCGGTTGTCCATTCATGGCTGAACTCTGCTTCCTCTGTTGACATGACAC
ACATCATCTCAATATCCGAATACGGACCATCAGTCTGACGACCAAGAGAGCCATAAACACCAAT
AGCCTTAACATCATCCCCATATTTATCCAATATTCGTTCCTTAATTTCATGAACAATCTTCATT
CTTTCTTCTAGTCATTATTATTGGTCCGTTCATAACACCCCTTGTATTACTGTTTATGTAAG
CAGACAGTTTTATTGTTCATGATGATATATTTTTATCTTGTGCAATGTAACATCAGAGATTTTG
AGACACAACGTGGCTTTCCCCGGCCCATGACCAAAATCCCTTAACGTGAGTTTTCGTTCCACTG
AGCGTCAGACCCCGTAGAAAAGATCAAAGGATCTTCTTGAGATCCTTTTTTTCTGCGCGTAATC
TGCTGCTTGCAAACAAAAAAACCACCGCTACCAGCGGTGGTTTGTTTGCCGGATCAAGAGCTAC
CAACTCTTTTTCCGAAGGTAACTGGCTTCAGCAGAGCGCAGATACCAAATACTGTTCTTCTAGT
GTAGCCGTAGTTAGGCCACCACTTCAAGAACTCTGTAGCACCGCCTACATACCTCGCTCTGCTA
ATCCTGTTACCAGTGGCTGCTGCCAGTGGCGATAAGTCGTGTCTTACCGGGTTGGACTCAAGAC
GATAGTTACCGGATAAGGCGCAGCGGTCGGGCTGAACGGGGGGTTCGTGCACACAGCCCAGCTT
GGAGCGAACGACCTACACCGAACTGAGATACCTACAGCGTGAGCTATGAGAAAGCGCCACGCTT
CCCGAAGGGAGAAAGGCGGACAGGTATCCGGTAAGCGGCAGGGTCGGAACAGGAGAGCGCACGA
GGGAGCTTCCAGGGGAAACGCCTGGTATCTTTATAGTCCTGTCGGGTTTCGCCACCTCTGACT
TGAGCGTCGATTTTTGTGATGCTCGTCAGGGGGCGGAGCCTATGGAAAAACGCCAGCAACGCG
GCCTTTTTACGGTTCCTGGCCTTTTGCTGGCCTTTTGCTCACATGTTCTTTCCTGCGTTATCCC
CTGATTCTGTGGATAACCGTATTACCGCCTTTGAGTGAGCTGATACCGCTCGCCGCAGCCGAAC
GACCGAGCGCAGCGAGTCAGTGAGCGAGGAAGCGGAAGAGCGCCTGATGCGGTATTTTCTCCTT
ACGCATCTGTGCGGTATTTCACACCGCATATGGTGCACTCTCAGTACAATCTGCTCTGATGCCG
CATAGTTAAGCCAGTATCTGCTCCCTGCTTGTGTGTTGGAGGTCGCTGAGTAGTGCGCGAGCAA
AATTTAAGCTACAACAAGGCAAGGCTTGACCGACAATTGCATGAAGAATCTGCTTAGGGTTAGG
CGTTTTGCGCTGCTTCGCGATGTACGGGCCAGATATAGCCGCGGCATCGATGATATCCATTGCA
TACGTTGTATCTATATCATAATATGTACATTTATATTGGCTCATGTCCAATATGACCGCCATGT
TGACATTGATTATTGACTAGTTATTAATAGTAATCAATTACGGGGTCATTAGTTCATAGCCCAT
ATATGGAGTTCCGCGTTACATAACTTACGGTAAATGGCCCGCCTGGCTGACCGCCCAACGACCC
CCGCCCATTGACGTCAATAATGACGTATGTTCCCATAGTAACGCCAATAGGGACTTTCCATTGA
CGTCAATGGGTGGAGTATTTACGGTAAACTGCCCACTTGGCAGTACATCAAGTGTATCATATGC
CAAGTCCGCCCCCTATTGACGTCAATGACGGTAAATGGCCCGCCTGGCATTATGCCCAGTACAT
GACCTTACGGGACTTTCCTACTTGGCAGTACATCTACGTATTAGTCATCGCTATTACCATGGTG
ATGCGGTTTTGGCAGTACATCAATGGGCGTGGATAGCGGTTTGACTCACGGGGATTTCCAAGTC
TCCACCCCATTGACGTCAATGGGAGTTTGTTTTGGCACCAAAATCAACGGGACTTTCCAAAATG
TCGTAACAACTCCGCCCCATTGACGCAAATGGGCGGTAGGCGTGTACGGTGGGAGGTCTATATA
AGCAGAGCTCGTTTAGTGAACCGTCAGATCGCCTGGAGACGCCATCCACGCTGTTTTGACCTCC
ATAGAAGACACCGGGACCGATCCAGCCTCCGCGGGCGCGCGTCGACGGGCGACGCAAACTTGG
GCCCACTCGAGAGGCGCGCCGAGCTCGCTGATCAGCCTCGACTGTGCCTTCTAGTTGCCAGCCA
TCTGTTGTTTGCCCCTCCCCCGTGCCTTCCTTGACCCTGGAAGGTGCCACTCCCACTGTCCTTT
```

Mosaic and Group M Gag_dmyr-patent.doc

Fig. 22 cont'd-43

```
CCTAATAAAATGAGGAAATTGCATCGCATTGTCTGAGTAGGTGTCATTCTATTCTGGGGGTGG
GGTGGGGCAGGACAGCAAGGGGGAGGATTGGGAAGACAATAGCAGGCATGCTGGGGAATTT
```

MOSAIC CLADE M HUMAN IMMUNODEFICIENCY VIRUS TYPE 1 (HIV-1) ENVELOPE IMMUNOGENS

This application is a continuation-in-part of U.S. application Ser. No. 11/990,222, filed Apr. 20, 2009, which is the U.S. national phase of International Application No. PCT/US2006/032907, filed Aug. 23, 2006, which designated the U.S. and claims priority from U.S. Provisional Application No. 60/710,154, filed Aug. 23, 2005, and U.S. Provisional Application No. 60/739,413, filed Nov. 25, 2005, the entire contents of which applications are incorporated herein by reference.

This invention was made with Government support under Contract No. DE-AC52-06NA25396 awarded by the U.S. Department of Energy. The Government has certain rights in the invention.

SEQUENCE

The instant application contains a "lengthy" Sequence Listing which has been submitted via CD-R in lieu of a printed paper copy, and is hereby incorporated by reference in its entirety. The attached CD-Rs, recorded on Jan. 27, 2009, are labeled CRF, "Copy 1" and "Copy 2", and contain identical copies of a 1.02 MB file named (15791373.TXT).

TECHNICAL FIELD

The present invention relates, in general, to an immunogenic composition (e.g., a vaccine) and, in particular, to a polyvalent immunogenic composition, such as a polyvalent HIV vaccine, and to methods of using same. The invention further relates to methods that use a genetic algorithm to create sets of polyvalent antigens suitable for use, for example, in vaccination strategies.

BACKGROUND

Designing an effective HIV vaccine is a many-faceted challenge. The vaccine preferably elicits an immune response capable of either preventing infection or, minimally, controlling viral replication if infection occurs, despite the failure of immune responses to natural infection to eliminate the virus (Nabel, Vaccine 20:1945-1947 (2002)) or to protect from superinfection (Altfeld et al, Nature 420:434-439 (2002)). Potent vaccines are needed, with optimized vectors, immunization protocols, and adjuvants (Nabel, Vaccine 20:1945-1947 (2002)), combined with antigens that can stimulate cross-reactive responses against the diverse spectrum of circulating viruses (Gaschen et al, Science 296:2354-2360 (2002), Korber et al, Br. Med. Bull. 58:19-42 (2001)). The problems that influenza vaccinologists have confronted for decades highlight the challenge posed by HIV-1:human influenza strains undergoing antigenic drift diverge from one another by around 1-2% per year, yet vaccine antigens often fail to elicit cross-reactive B-cell responses from one year to the next, requiring that contemporary strains be continuously monitored and vaccines be updated every few years (Korber et al, Br. Med. Bull. 58:19-42 (2001)). In contrast, co-circulating individual HIV-1 strains can differ from one another by 20% or more in relatively conserved proteins, and up to 35% in the Envelope protein (Gaschen et al, Science 296:2354-2360 (2002), Korber et al, Br. Med. Bull. 58:19-42 (2001)).

Different degrees of viral diversity in regional HIV-1 epidemics provide a potentially useful hierarchy for vaccine design strategies. Some geographic regions recapitulate global diversity, with a majority of known HIV-1 subtypes, or clades, co-circulating (e g., the Democratic Republic of the Congo (Mokili & Korber, J. Neurovirol 11 (Suppl. 1):66-75 (2005)); others are dominated by two subtypes and their recombinants (e.g., Uganda (Barugahare et al, J. Virol. 79:4132-4139 (2005)), and others by a single subtype (e.g., South Africa (Williamson et al, AIDS Res. Hum. Retroviruses 19:133-144 (2003)). Even areas with predominantly single-subtype epidemics must address extensive within-clade diversity (Williamson et al, AIDS Res. Hum. Retroviruses 19:133-44 (2003)) but, since international travel can be expected to further blur geographic distinctions, all nations would benefit from a global vaccine.

Presented herein is the design of polyvalent vaccine antigen sets focusing on T lymphocyte responses, optimized for either the common B and C subtypes, or all HIV-1 variants in global circulation [the HIV-1 Main (M) group]. Cytotoxic T-lymphocytes (CTL) directly kill infected, virus-producing host cells, recognizing them via viral protein fragments (epitopes) presented on infected cell surfaces by human leukocyte antigen (HLA) molecules. Helper T-cell responses control varied aspects of the immune response through the release of cytokines. Both are likely to be crucial for an HIV-1 vaccine: CTL responses have been implicated in slowing disease progression (Oxenius et al, J. Infect. Dis. 189:1199-208 (2004)); vaccine-elicited cellular immune responses in nonhuman primates help control pathogenic SIV or SHIV, reducing the likelihood of disease after challenge (Barouch et al, Science 290:486-92 (2000)); and experimental depletion of CD8+ T-cells results in increased viremia in SIV infected rhesus macaques Schmitz et al, Science 283:857-60 (1999)). Furthermore, CTL escape mutations are associated with disease progression (Barouch et al, J. Virol, 77:7367-75 (2003)), thus vaccine-stimulated memory responses that block potential escape routes may be valuable.

The highly variable Env protein is the primary target for neutralizing antibodies against HIV; since immune protection will likely require both B-cell and T-cell responses (Moore and Burton, Nat. Med. 10:769-71 (2004)), Env vaccine antigens will also need to be optimized separately to elicit antibody responses. T-cell-directed vaccine components, in contrast, can target the more conserved proteins, but even the most conserved HIV-1 proteins are diverse enough that variation is an issue. Artificial central-sequence vaccine approaches (e.g., consensus sequences, in which every amino acid is found in a plurality of sequences, or maximum likelihood reconstructions of ancestral sequences (Gaschen et al, Science 296:2354-60 (2002), Gao et al, J. Virol. 79:1154-63 (2005), Doria-Rose et al, J. Virol. 79:11214-24 (2005), Weaver et at, J. Virol., in press)) are promising; nevertheless, even centralized strains provide limited coverage of HIV-1 variants, and consensus-based reagents fail to detect many autologous T-cell responses (Altfeld et al, J. Virol. 77:7330-40 (2003)).

Single amino acid changes can allow an epitope to escape T-cell surveillance; since many T-cell epitopes differ between HIV-1 strains at one or more positions, potential responses to any single vaccine antigen are limited. Whether a particular mutation results in escape depends upon the specific epitope/T-cell combination, although some changes broadly affect between-subtype cross-reactivity (Norris et al, AIDS Res. Hum. Retroviruses 20:315-25 (2004)). Including multiple variants in a polyvalent vaccine could enable responses to a broader range of circulating variants, and could also prime the immune system against common escape mutants (Jones et al, J. Exp. Med. 200:1243-56 (2004)). Escape from one T-cell receptor may create a variant that is susceptible to another (Allen et al, J. Virol. 79:12952-60 (2005), Feeney et al, J. Immunol. 174:7524-30 (2005)), so stimulating polyclonal responses to epitope variants may be beneficial (Killian et al, Aids 19:887-96 (2005)). Escape mutations that inhibit processing (Milicic et al, J. Immunol. 175:4618-26 (2005)) or HLA binding (Ammaranond et al, AIDS Res. Hum. Retroviruses 21:395-7 (2005)) cannot be directly countered by a T-cell with a different specificity, but responses to overlapping epitopes may block even some of these escape routes.

The present invention relates to a polyvalent vaccine comprising several "mosaic" proteins (or genes encoding these proteins). The candidate vaccine antigens can be cocktails of k composite proteins (k being the number of sequence variants in the cocktail), optimized to include the maximum number of potential T-cell epitopes in an input set of viral proteins. The mosaics are generated from natural sequences: they resemble natural proteins and include the most common forms of potential epitopes. Since CD8+ epitopes are contiguous and typically nine amino-acids long, sets of mosaics can be scored by "coverage" of nonamers (9-mers) in the natural sequences (fragments of similar lengths are also well represented). 9-Mers not found at least three times can be excluded. This strategy provides the level of diversity coverage achieved by a massively polyvalent multiple-peptide vaccine but with important advantages: it allows vaccine delivery as intact proteins or genes, excludes low-frequency or unnatural epitopes that are not relevant to circulating strains, and its intact protein antigens are more likely to be processed as in a natural infection.

SUMMARY OF THE INVENTION

In general, the present invention relates to an immunogenic composition. More specifically, the invention relates to a polyvalent immunogenic composition (e.g., an HIV vaccine), and to methods of using same. The invention further relates to methods that involve the use of a genetic algorithm to design sets of polyvalent antigens suitable for use as vaccines.

Objects and advantages of the present invention will be clear from the description that follows.

BRIEF DESCRIPTION OF THE DRAWINGS

In FIGS. 1A, 1C and 1E, the scores for each consecutive 9-mer are plotted in their natural order to show how diversity varies in different protein regions; both p24 in the center of Gag and the central region of Nef are particularly highly conserved. In FIGS. 1B, 1D and 1F, the scores for each 9-mer are reordered by coverage (a strategy also used in FIG. 4), to provide a sense of the overall population coverage of a given protein. Coverage of gp120, even with 8 variant 9-mers, is particularly poor (FIGS. 1E and 1F).

FIGS. 2A-2C. Mosaic initialization, scoring, and optimization. FIG. 2A) A set of k populations is generated by random 2-point recombination of natural sequences (1-6 populations of 50-500 sequences each have been tested). One sequence from each population is chosen (initially at random) for the mosaic cocktail, which is subsequently optimized. The cocktail sequences are scored by computing coverage (defined as the mean fraction of natural-sequence 9-mers included in the cocktail, averaged over all natural sequences in the input data set). Any new sequence that covers more epitopes will increase the score of the whole cocktail. FIG. 2B) The fitness score of any individual sequence is the coverage of a cocktail containing that sequence plus the current representatives from other populations. FIG. 2C) Optimization. 1) two "parents" are chosen: the higher-scoring of a randomly chosen pair of recombined sequences, and either (with 50% probability) the higher-scoring sequence of a second random pair, or a randomly chosen natural sequence. 2) Two-point recombination between the two parents is used to generate a "child" sequence. If the child contains unnatural or rare 9-mers, it is immediately rejected, otherwise it is scored (Gaschen et al, Science 296-2354-2360 (2002)). If the score is higher than that of any of four randomly-selected population members, the child is inserted in the population in place of the weakest of the four, thus evolving an improved population; 4) if its score is a new high score, the new child replaces the current cocktail member from its population. Ten cycles of child generation are repeated for each population in turn, and the process iterates until improvement stalls.

FIG. 4A) Non-optimal natural sequences selected from among strains being used in vaccine studies (Kong et al, J. Virol. 77:12764-72 (2003)) including an individual clade A, B, and C viral sequences (Gag: GenBank accession numbers AF004885, K03455, and U52953;Nef core: AF069670, K02083, and U52953). FIG. 4B) Optimum set of natural sequences [isolates US2 (subtype B, USA), 70177 (subtype C, India), and 99T1H.R2399 (subtype CRF15_01B Thailand); accession numbers AY173953, AF533131, and$_{13}$ AF530576] selected by choosing the single sequence with maximum coverage, followed by the sequence that had the best coverage when combined with the first (i.e. the best complement), and so on, selected for M group coverage FIG. 4C) Consensus sequence cocktail (M group, B- and C-subtypes). FIG. 4D) 3 mosaic sequences, FIG. 4E) 4 mosaic sequences, FIG. 4F) 6 mosaic sequences. FIGS. 4D-4F were all optimized for M group coverage.

FIGS. 5A and 5B. Overall coverage of vaccine candidates: coverage of 9-mers in C clade sequences using different input data sets for mosaic optimization, allowing different numbers of antigens, and comparing to different candidate vaccines. Exact (blue), 8/9 (one-off; red), and 7/9 (two-off; yellow) coverage was computed for mono- and polyvalent vaccine candidates for Gag (FIG. 5A) and Nef (core) (FIG. 5B) for four test situations: within-clade (C-clade-optimized candidates scored for C-clade coverage). between-clade (B-clade-optimized candidates scored for C-clade coverage), global-against-single-subtype (M-group-optimized candidates scored for C-clade coverage), global-against-global (M-group-optimized candidates scored for global coverage). Within each set of results, vaccine candidates are grouped by number of sequences in the cocktail (1-6); mosaic sequences are plotted with darker colors. "Non-opt" refers to one set of sequences moving into vaccine trials (Kong et al, J. Virol. 77:12764-72 (2003)); "mosaic" denotes sequences generated by the genetic algorithm; "opt. natural" denotes intact natural sequences selected for maximum 9-mer coverage; "MBC consensus" denotes a cocktail of 3 consensus sequences, for M-group, B-subtype, and C-subtype. For ease of comparison, a dashed line marks the coverage of a 4-sequence set of M-group mosaics (73.7-75.6%). Over 150 combinations of mosaic-number, virus subset, protein region, and optimization and test sets were tested. The C clade/B clade/M group comparisons illustrated in this figure are generally representative of within-clade, between-clade, and M group coverage. In particular, levels of mosaic coverage for B and C lade were very similar, despite there being many more C clade sequences in the Gag collection, and many more B clade sequences in the Nef collection (see FIG. 6 for a full B and C lade comparison). There were relatively few A and G clade sequences in the alignments (24 Gag, 75 Nef), and while 9-mer coverage by M-group optimized mosaics was not as high as for subtypes for B and C clades (4-mosaic coverage for A and G subtypes was 63% for Gag, 74% for Nef), it was much better than a non-optimal cocktail (52% Gag, 52% for Nef).

FIGS. 7A and 7B. The distribution of 9-mers by frequency of occurrence in natural, consensus, and mosaic sequences. Occurrence counts (y-axis) for different 9-mer frequencies (x-axis) for vaccine cocktails produced by several methods. FIG. 7A: frequencies from 0-60% (for 9-mer frequencies >60%, the distributions are equivalent for all methods). FIG. 7B: Details of low-frequency 9-mers. Natural sequences have large numbers of rare or unique-to-isolate 9-mers (bottom right, FIGS. 7A and 7B); these are unlikely to induce useful vaccine responses. Selecting optimal natural sequences does select for more common 9-mers, but rare and unique 9-mers are still included (top right, FIGS. 7A and 7B). Consensus cocktails, in contrast, under-represent uncommon 9-mers, especially below 20% frequency (bottom left, FIGS. 7A and 7B). For mosaic sequences, the number of lower-frequency 9-mers monotonically increases with the number of sequences (top left, each panel), but unique-to-isolate 9-mers are completely excluded (top left of right panel: * marks the absence of 9-mers with frequencies<0.005).

FIGS. 8A-8D. HLA binding potential of vaccine candidates. FIGS. 8A and 8B) HLA binding motif counts. FIGS. 8C and 8D) number of unfavorable amino acids. In all graphs: natural sequences are marked with black circles (λ); consensus sequences with blue triangles (σ); inferred ancestral sequences with green squares (v); and mosaic sequences with red diamonds (♥). Left panel (FIGS. 8A and 8C) shows HLA-binding-motif counts (FIG. 8A) and counts of unfavorable amino acids (FIG. 8C) calculated for individual sequences; Right panel (FIGS. 8B and 8D) shows HLA binding motifs counts (FIG. 8B) and counts of unfavorable amino acids (FIG. 8D) calculated for sequence cocktails. The top portion of each graph (box-and-whiskers graph) shows the distribution of respective counts (motif counts or counts of unfavorable amino acids) based either on alignment of M group sequences (for individual sequences, FIGS. 8A and 8C) or on 100 randomly composed cocktails of three sequences, one from each A, B and C subtypes (for sequence cocktails, FIGS. 8B and 8D). The alignment was downloaded from the Los Alamos HIV database. The box extends from the 25 percentile 25 to the 75 percentile, with the line at the median. The whiskers extending outside the box show the highest and lowest values. Amino acids that are very rarely found as C-terminal anchor residues are G, S, T, P, N, Q, D, E, and H, and tend to be small, polar, or negatively charged (Yusim et al, S. Virol. 76:8757-8768 (2002)). Results are shown for Gag, but the same qualitative results hold for Nef core and complete Nef. The same procedure was done for supertype motifs with results qualitatively similar to the results for HLA binding motifs (data not shown).

FIG. 9. Mosaic protein sets limited to 4 sequences (k=4), spanning Gag and the central region of Nef, optimized for subtype B, subtype C, and the M group. Figure discloses SEQ ID NOS 1-84, respectively, in order of appearance.

FIG. 10. Mosaic sets for Env and Pol. Figure discloses SEQ ID NOS 85-168, respectively, in order of appearance.

FIG. 11. This plot is alignment independent, based on splintering all M group proteins, (database and CHAVI, one sequence per person) into all possible 9-mers, attending to their frequencies and then looking for matches and near matches in each vaccine antigen or cocktail with the database.

FIGS. 14A-14D. Plots resorted by frequency of 9-mer matches for each vaccine proposed for use.

FIG. 17. Coverage of the HIV database plus CHAVI sequences (N=2020).

FIG. 18. Differences in acute infection patient sequences compared to patient consensus.

Figure 19:
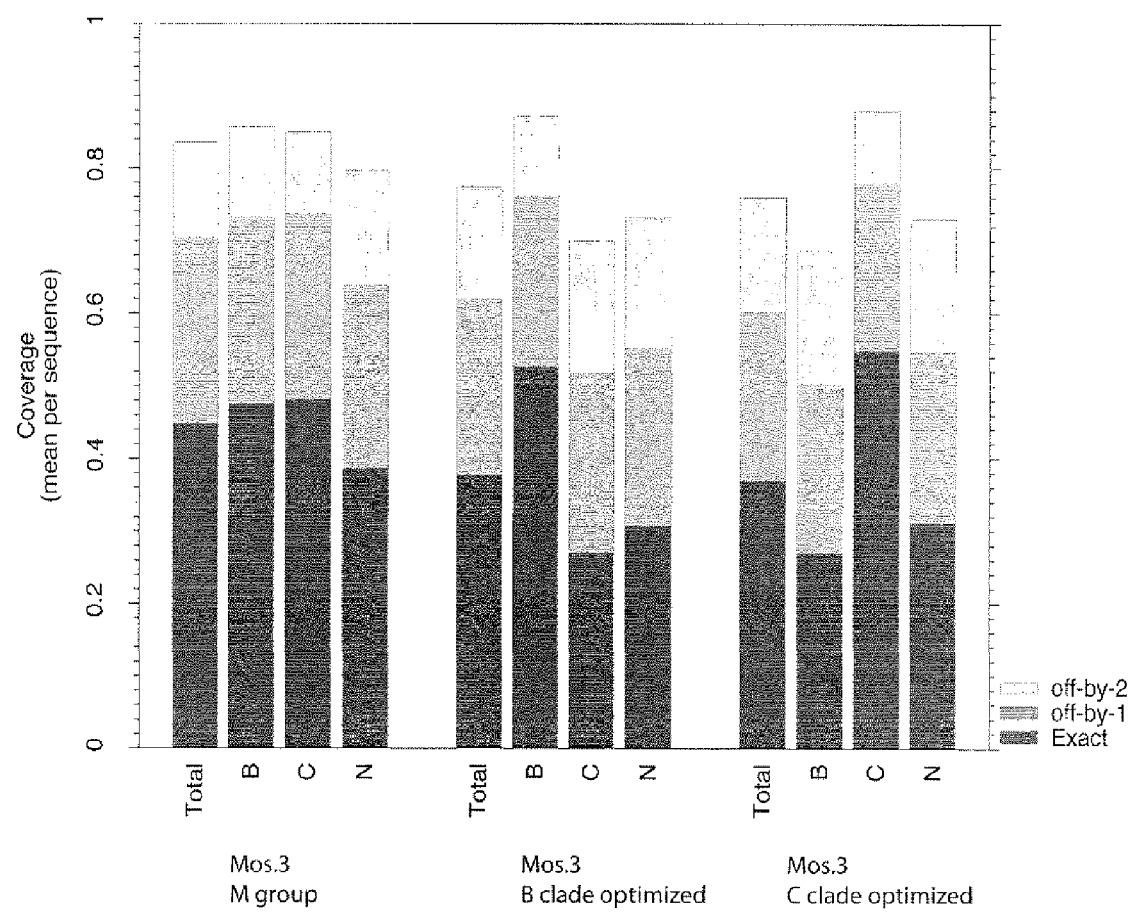

FIG. 19. The compromise and benefit in terms of coverage for Env M group versus subtype-specific design.

FIG. 21. Gag, Nef and Env sequences. Figure discloses SEQ ID NOS 169-179, respectively, in order of appearance.

FIG. 22. Mosaic gag and nef genes and M consensus gag and nef genes. Figure discloses SEQ ID NOS 180-187, 183, 188, 184, 189-191, 183, 188, 184, 192-194, 183-184, 195-197, 183-184, 198-200, 183-184, 201-204, 183-184, 205-207, 183-184, 208-211, 183-184, 212-217, 183-184, 208 and 218, respectively, in order of appearance.

DETAILED DESCRIPTION OF THE INVENTION

Figure 1B:
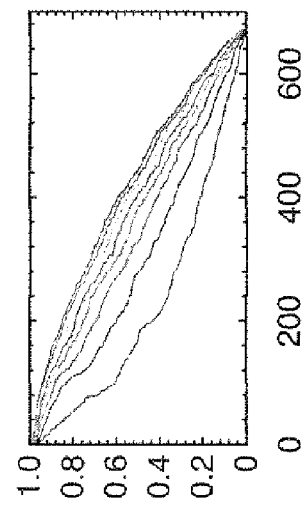
FIGS. 1A-1F. The upper bound of potential epitope coverage of the HIV-1 M group. The upper bound for population coverage of 9-mers for increasing numbers of variants is shown, for k=1-8 variants. A sliding window of length nine was applied across aligned sequences, moving down by one position. Different colors denote results for different numbers of sequences. At each window, the coverage given by the k most common 9-mers is plotted for Gag (FIGS. 1A and 1B), Nef (FIGS. 1C and 1D) and Env gp120 (FIGS. 1E and 1F). Gaps inserted to maintain the alignment are treated as characters. The diminishing returns of adding more variants are evident, since as k increases, increasingly rare forms are added.
Figure 1D:
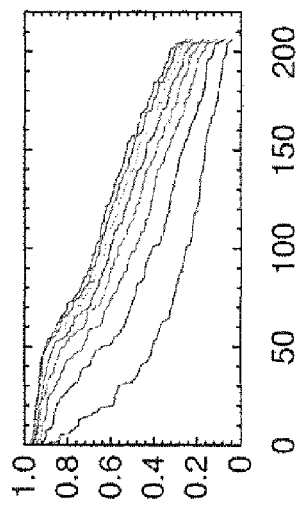
Figure 1F:
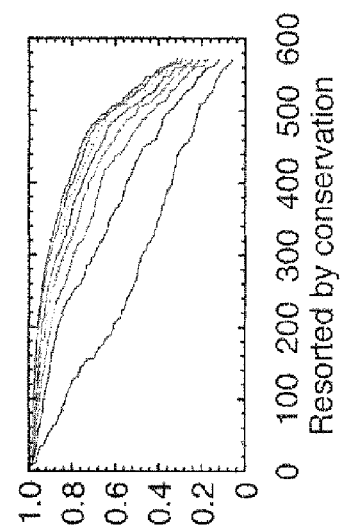
Figure 1A:
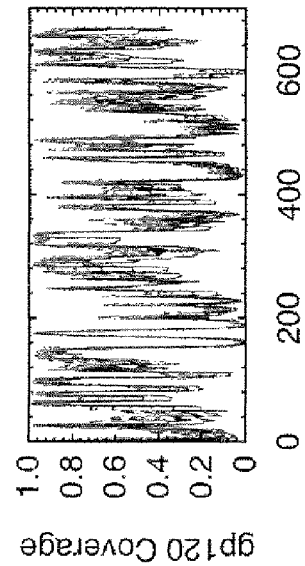
Figure 1C:
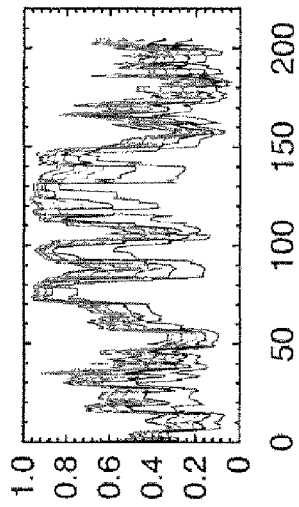
Figure 1E:
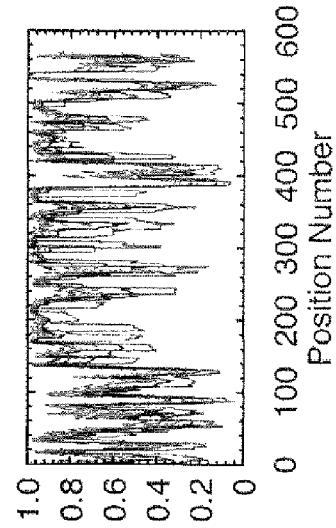

The present invention results from the realization that a polyvalent set of antigens comprising synthetic viral proteins, the sequences of which provide maximum coverage of non-rare short stretches of circulating viral sequences, constitutes a good vaccine candidate. The invention provides a "genetic algorithm" strategy to create such sets of polyvalent antigens as mosaic blends of fragments of an arbitrary set of natural protein sequences provided as inputs. In the context of HIV, the proteins Gag and Nef are ideal candidates for such antigens. To expand coverage, Pol and/or Env can also be used. The invention further provides optimized sets for these proteins.

The genetic algorithm strategy of the invention uses unaligned protein sequences from the general population as an input data set, and thus has the virtue of being "alignment independent". It creates artificial mosaic proteins that resemble proteins found in nature—the success of the consensus antigens in small animals models suggest this works well. 9 Mers are the focus of the studies described herein, however, different length peptides can be selected depending on the intended target. In accordance with the present approach, 9 mers (for example) that do not exist in nature or that are very rare can be excluded—this is an improvement relative to consensus sequences since the latter can contain some 9 mers (for example) that have not been found in nature, and relative to natural strains that almost invariably contain some 9 mers (for example) that are unique to that strain. The definition of fitness used for the genetic algorithm is that the most "fit" polyvalent cocktail is the combination of mosaic strains that gives the best coverage (highest fraction of perfect matches) of all of the 9 mers in the population and is subject to the constraint that no 9 mer is absent or rare in the population.

The mosaics protein sets of the invention can be optimized with respect to different input data sets—this allows use of current data to assess virtues of a subtype or region specific vaccines from a T cell perspective. By way of example, options that have been compared include:

1) Optimal polyvalent mosaic sets based on M group, B clade and C lade. The question presented was how much better is intra-clade coverage than inter-clade or global.
2) Different numbers of antigens: 1, 3, 4, 6
3) Natural strains currently in use for vaccine protocols just to exemplify "typical" strains (Merck, VRC)
4) Natural strains selected to give the best coverage of 9-mers in a population
5) Sets of consensus: A+B+C.
6) Optimized cocktails that include one "given" strain in a polyvalent antigen, one ancestral+3 mosaic strains, one consensus+3 mosaic strains.
7) Coverage of 9 mers that were perfectly matched was compared with those that match 8/9, 7/9, and 6/9 or less.

This is a computationally difficult problem, as the best set to cover one 9-mer may not be the best set to cover overlapping 9-mers.

It will be appreciated from a reading of this disclosure that the approach described herein can be used to design peptide reagents to test HIV immune responses, and be applied to other variable pathogens as well. For example, the present approach can be adapted to the highly variable virus Hepatitis C.

The proteins/polypeptides/peptides ("immunogens") of the invention can be formulated into compositions with a pharmaceutically acceptable carrier and/or adjuvant using techniques well known in the art. Suitable routes of administration include systemic (e.g., intramuscular or subcutaneous), oral, intravaginal, intrarectal and intranasal.

The immunogens of the invention can be chemically synthesized and purified using methods which are well known to the ordinarily skilled artisan.

The immunogens can also be synthesized by well-known recombinant DNA techniques.

Nucleic acids encoding the immunogens of the invention can be used as components of, for example, a DNA vaccine wherein the encoding sequence is administered as naked DNA or, for example, a minigene encoding the immunogen can be present in a viral vector. The encoding sequences can be expressed, for example, in mycobacterium, in a recombinant chimeric adenovirus, or in a recombinant attenuated vesicular stomatitis virus. The encoding sequence can also be present, for example, in a replicating or non-replicating adenoviral vector, an adeno-associated virus vector, an attenuated mycobacterium tuberculosis vector, a *Bacillus* Calmette Guerin (BCG) vector, a vaccinia or Modified Vaccinia Ankara (MVA) vector, another pox virus vector, recombinant polio and other enteric virus vector, *Salmonella* species bacterial vector, *Shigella* species bacterial vector, Venezuelean Equine Encephalitis Virus (VEE) vector, a Semliki Forest Virus vector, or a Tobacco Mosaic Virus vector. The encoding sequence, can also be expressed as a DNA plasmid with, for example, an active promoter such as a CMV promoter. Other live vectors can also be used to express the sequences of the invention. Expression of the immunogen of the invention can be induced in a patient's own cells, by introduction into those cells of nucleic acids that encode the immunogen, preferably using codons and promoters that optimize expression in human cells. Examples of methods of making and using DNA vaccines are disclosed in U.S. Pat. Nos. 5,580,859, 5,589,466, and 5,703,055. Examples of methods of codon optimization are described in Haas et al, Current Biology 6:315-324 (1996) and in Andre et al, J. Virol. 72(2):1497-1503 (1998).

It will be appreciated that adjuvants can be included in the compositions of the invention (or otherwise administered to enhance the immunogenic effect). Examples of suitable adjuvants include TRL-9 agonists, TRL-4 agonists, and TRL-7, 8 and 9 agonist combinations ( as well as alum). Adjuvants can take the form of oil and water emulsions. Squalene adjuvants can also be used.

The composition of the invention comprises an immunologically effective amount of the immunogen of this invention, or nucleic acid sequence encoding same, in a pharmaceutically acceptable delivery system. The compositions can be used for prevention and/or treatment of virus infection (e.g. HIV infection). As indicated above, the compositions of the invention can be formulated using adjuvants, emulsifiers, pharmaceutically-acceptable carriers or other ingredients routinely provided in vaccine compositions. Optimum formulations can be readily designed by one of ordinary skill in the art and can include formulations for immediate release and/or for sustained release, and for induction of systemic immunity and/or induction of localized mucosal immunity (e.g, the formulation can be designed for intranasal, intravaginal or intrarectal administration). As noted above, the present compositions can be administered by any convenient route including subcutaneous, intranasal, oral, intramuscular, or other parenteral or enteral route. The immunogens can be administered as a single dose or multiple doses. Optimum immunization schedules can be readily determined by the ordinarily skilled artisan and can vary with the patient, the composition and the effect sought.

The invention contemplates the direct use of both the immunogen of the invention and/or nucleic acids encoding same and/or the immunogen expressed as as indicated above. For example, a minigene encoding the immunogen can be used as a prime and/or boost.

The invention includes any and all amino acid sequences disclosed herein, as well as nucleic acid sequences encoding same (and nucleic acids complementary to such encoding sequences).

Specifically disclosed herein are vaccine antigen sets optimized for single B or C subtypes, targeting regional epidemics, as well as for all HIV-1 variants in global circulation [the HIV-1 Main (M) group]. In the study described in Example 1 that follows, the focus is on designing polyvalent vaccines specifically for T-cell responses. HIV-1 specific T-cells are likely to be crucial to an HIV-1-specific vaccine response: CTL responses are correlated with slow disease progression in humans (Oxenius et al, J. Infect. Dis. 189: 1199-1208 (2004)), and the importance of CTL responses in non-human primate vaccination models is well-established. Vaccine elicited cellular immune responses help control pathogenic SIV or SHIV, and reduce the likelihood of disease after challenge with pathogenic virus (Barouch et al, Science 290:486-492 (2000)). Temporary depletion of CD8+ T cells results in increased viremia in SIV-infected rhesus macaques (Schmitz et al, Science 283:857-860 (1999)). Furthermore, the evolution of escape mutations has been associated with disease progression, indicating that CTL responses help constrain viral replication in vivo (Barouch et al, J. Virol. 77:7367-7375 (2003)), and so vaccine-stimulated memory responses that could block potential escape routes may be of value. While the highly variable Envelope (Env) is the primary target for neutralizing antibodies against HIV, and vaccine antigens will also need to be tailored to elicit these antibody responses (Moore & Burton, Nat. Med. 10:769-771 (2004)), T-cell vaccine components can target more conserved proteins to trigger responses that are more likely to cross-react. But even the most conserved HIV-1 proteins are diverse enough that variation will be an issue. Artificial central-sequence vaccine approaches, consensus and ancestral sequences (Gaschen et al, Science 296:2354-2360 (2002), Gao et al, J. Virol. 79:1154-1163 (2005), Doria-Rose et al, J. Virol, 79: 11214-11224 (2005)), which essentially "split the differences" between strains, show promise, stimulating responses with enhanced cross-reactivity compared to natural strain vaccines (Gao et al, J. Virol. 79:1154-1163 (2005)) (Liao et al. and Weaver et al., submitted.) Nevertheless, even central strains cover the spectrum of HIV diversity to a very limited extent, and consensus-based peptide reagents fail to detect many autologous CD8+ T-cell responses (Altfeld et al, J. Virol. 77:7330-7340 (2003)).

A single amino acid substitution can mediate T-cell escape, and as one or more amino acids in many T-cell epitopes differ between HIV-1 strains, the potential effectiveness of responses to any one vaccine antigen is limited. Whether a particular mutation will diminish T-cell cross-reactivity is epitope- and T-cell-specific, although some changes can broadly affect between-clade cross-reactivity (Norris et al, AIDS Res. Hum. Retroviruses 20:315-325 (2004)). Including more variants in a polyvalent vaccine could enable responses to a broader range of circulating variants. It could also prime the immune system against common escape variants (Jones et al, J. Exp. Med. 200:1243-1256 (2004)); escape from one T-cell receptor might create a variant that is susceptible to another (Lee et al, J. Exp. Med. 200:1455-1466 (2004)), thus stimulating polyclonal responses to epitope variants may be beneficial (Killian et al. AIDS 19:887-896 (2005)). Immune escape involving avenues that inhibit processing (Milicic et al, J. Immunol. 175:4618-4626 (2005)) or HLA binding (Ammaranond et al, AIDS Res. Hum. Retroviruses 21:395-397 (2005)) prevent epitope presentation, and in such cases the escape variant could not be countered by a T-cell with a different specificity. However, it is possible the presence of T-cells that recognize overlapping epitopes may in some cases block these even escape routes.

Certain aspects of the invention can be described in greater detail in the non-limiting Examples that follow.

EXAMPLE 1

Experimental Details

HIV-1 sequence data. The reference alignments from the 2005 HIV sequence database (URL: hiv-dot-lanl-dot-gov), which contain one sequence per person, were used, supplemented by additional recently available C subtype Gag and Nef sequences from Durban, South Africa (GenBank accession numbers AY856956-AY857186) (Kiepiela et al, Nature 432:769-75 (2004)). This set contained 551 Gag and 1,131 Nef M group sequences from throughout the globe; recombinant sequences were included as well as pure subtype sequences for exploring M group diversity. The subsets of these alignments that contained 18 A, 102 B, 228 C, and 6 G subtype (Gag), and 62 A, 454 B, 284 C, and 13 G subtype sequences (Net) sequences were used for within- and between-single-clade optimizations and comparisons.

The genetic algorithm. GAs are computational analogues of biological processes (evolution, populations, selection, recombination) used to find solutions to problems that are difficult to solve analytically (Holland, Adaptation in Natural and Artificial Systems: An Introductory Analysis with Applicatoins to Biology, Control, and Artificial Intelligence, (M.I.T, Press, Cambridge, Mass. (1992))). Solutions for a given input are "evolved" though a process of random modification and selection according to a "fitness" (optimality) criterion. GAs come in many flavors; a "steady-state coevolutionary multi-population" GA was implemented. "Steady-state" refers to generating one new candidate solution at a time, rather than a whole new population at once; and "co-evolutionary" refers to simultaneously evolving several distinct populations that work together to form a complete solution. The input is an unaligned set of natural sequences; a candidate solution is a set of k pseudo-natural "mosaic" sequences, each of which is formed by concatenating sections of natural sequences. The fitness criterion is population coverage, defined as the proportion of all 9-amino-acid sequence fragments (potential epitopes) in the input sequences that are found in the cocktail.

To initialize the GA (FIG. 2), k populations of n initial candidate sequences are generated by 2-point recombination between randomly selected natural sequences. Because the input natural sequences are not aligned, "homologous" crossover is used: crossover points in each sequence are selected by searching for short matching strings in both sequences; strings of $c-1=8$, were used where a typical epitope length is $c=9$. This ensures that the recombined sequences resemble natural proteins: the boundaries between sections of sequence derived from different strains are seamless, the local sequences spanning the boundaries are always found in nature, and the is mosaics are prevented from acquiring large insertions/deletions or unnatural combinations of amino acids. Mosaic sequence lengths fall within the distribution of natural sequence lengths as a consequence of mosaic construction: recombination is only allowed at identical regions, reinforced by an explicit software prohibition against excessive lengths to prevent reduplication of repeat regions. (Such "in frame" insertion of reduplicated epitopes could provide another way of increasing coverage without generating unnatural 9-mers, but their inclusion would create "unnatural" proteins.) Initially, the cocktail contains one randomly chosen "winner" from each population. The fitness score for any individual sequence in a population is the coverage value for the cocktail consisting of that sequence plus the current winners from the other populations. The individual fitness of any sequence in a population therefore depends dynamically upon the best sequences found in the other populations.

Optimization proceeds one population at a time. For each iteration, two "parent" sequences are chosen. The first parent is chosen using "2-tournament" selection: two sequences are picked at random from the current population, scored, and the better one is chosen. This selects parents with a probability inversely proportional to their fitness rank within the population, without the need to actually compute the fitness of all individuals. The second parent is chosen in the same way (50% of the time), or is selected at random from the set of natural sequences. 2-point homologous crossover between the parents is then used to generate a "child" sequence. Any child containing a 9-mer that was very rare in the natural population (found less than 3 times) is rejected immediately. Otherwise, the new sequence is scored, and its fitness is compared with the fitnesses of four randomly chosen sequences from the same population. If any of the four randomly chosen sequences has a score lower than that of the new sequence, it is replaced in the population by the new sequence. Whenever a sequence is encountered that yields a better score than the current population "winner", that sequence becomes the winner for the current population and so is subsequently used in the cocktail to evaluate sequences in other populations. A few such optimization cycles (typically 10) are applied to each population in turn, and this process continues cycling through the populations until evolution stalls (i.e. no improvement has been made for a defined number of generations). At this point, the entire procedure is restarted using newly generated random starting populations, and the restarts are continued until no further improvement is seen. The GA was run on each data set with $n=50$ or 500;each run was continued until no further improvement occurred for 12-24 hours on a 2 GHz Pentium processor. Cocktails were generated having $k=1, 3, 4,$ or 6 mosaic sequences.

The GA also enables optional inclusion of one or more fixed sequences of interest (for example, a consensus) in the cocktail and will evolve the other elements of the cocktail in order to optimally complement that fixed strain. As these solutions were suboptimal, they are not included here. An additional program selects from the input file the k best natural strains that in combination provide the best population coverage.

Comparison with other polyvalent vaccine candidates. Population coverage scores were computed for other potential mono- or polyvalent vaccines to make direct comparisons with the mosaic-sequence vaccines, tracking identities with population 9-mers, as well as similarities of 8/9 and 7/9 amino acids. Potential vaccine candidates based on natural strains include single strains (for example, a single C strain for a vaccine for southern Africa (Williamson et al, AIDS Res. Hum. Retroviruses 19:133-44 (2003))) or combinations of natural strains (for example, one each of subtype A, B, and C (Kong et al, J. Virol. 77:12764-72 (2003)). To date, natural-strain vaccine candidates have not been systematically selected to maximize potential T-cell epitope coverage; vaccine candidates were picked from the literature to be representative of what could be expected from unselected vaccine candidates. An upper bound for coverage was also determined using only intact natural strains: optimal natural-sequence cocktails were generated by selecting the single sequence with the best coverage of the dataset, and then successively adding the most complementary sequences up to a given k. The comparisons included optimal natural-sequence cocktails of various sizes, as well as consensus sequences, alone or in combination (Gaschen et al, Science 296:2354-60 (2002)), to represent the concept of central, synthetic vaccines. Finally, using the fixed-sequence option in the GA, consensus-plus-mosaic combinations in the comparisons; these scores were essentially equivalent to all-mosaic combinations were included for a given k (data not shown). The code used for performing these analyses are available at: ftp://ftp-t10/pub/btlk/mosaics.

Results

Protein Variation. In conserved HIV-1 proteins, most positions are essentially invariant, and most variable positions have only two to three amino acids that occur at appreciable frequencies, and variable positions are generally well dispersed between conserved positions. Therefore, within the boundaries of a CD8+ T-cell epitope (8-12 amino acids, typically nine), most of the population diversity can be covered with very few variants. FIG. 1 shows an upper bound for population coverage of 9-mers (stretches of nine contiguous amino acids) comparing Gag, Nef, and Env for increasing numbers of variants, sequentially adding variants that provide the best coverage. In conserved regions, a high degree of population coverage is achieved with 2-4 variants. By contrast, in variable regions like Env, limited population coverage is possible even with eight variants. Since each new addition is rarer, the relative benefits of each addition diminish as the number of variants increases.

Vaccine design optimization strategies FIG. 1 shows an idealized level of 9-mer coverage. In reality, high-frequency 9-mers often conflict: because of local co-variation, the optimal amino acid for one 9-mer may differ from that for an overlapping 9-mer. To design mosaic protein sets that optimize population coverage, the relative benefits of each amino acid must be evaluated in combination with nearby variants. For example, Alanine (Ala) and Glutamate (Glu) might each frequently occur in adjacent positions, but if the Ala-Glu combination is never observed in nature, it should be excluded from the vaccine. Several optimization strategies were investigated: a greedy algorithm, a semi-automated compatible-9mer assembly strategy, an alignment-based genetic algorithm (GA), and an alignment-independent GA.

The alignment-independent GA generated mosaics with the best population coverage. This GA generates a user-specified number of mosaic sequences from a set of unaligned protein sequences, explicitly excluding rare or unnatural epitope-length fragments (potentially introduced at recombination breakpoints) that could induce non-protective vaccine-antigen-specific responses. These candidate vaccine sequences resemble natural proteins, but are assembled from frequency-weighted fragments of database sequences recombined at homologous breakpoints (FIG. 2); they approach maximal coverage of 9-mers for the input population.

Figure 3:
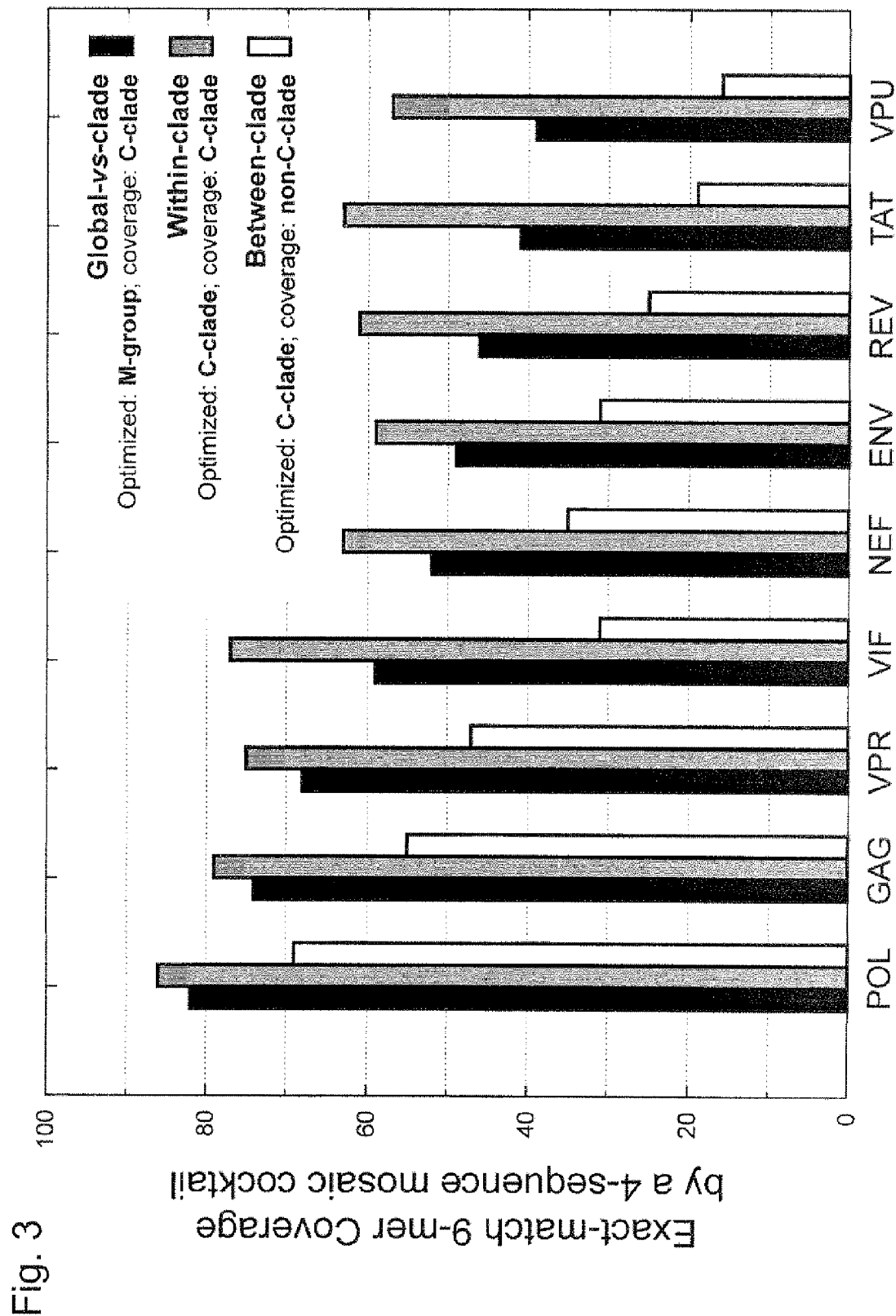
FIG. 3. Mosaic strain coverage for all HIV proteins. The level of 9-mer coverage achieved by sets of four mosaic proteins for each HIV protein is shown, with mosaics optimized using either the M group or the C subtype. The fraction of C subtype sequence 9-mers covered by mosaics optimized on the C subtype (within-clade optimization) is shown in gray. Coverage of 9-mers found in non-C subtype M-group sequences by subtype-C-optimized mosaics (between-clade coverage) is shown in white. Coverage of subtype C sequences by M-group optimized mosaics is shown in black. B clade comparisons gave comparable results (data not shown).
Figure 4A:
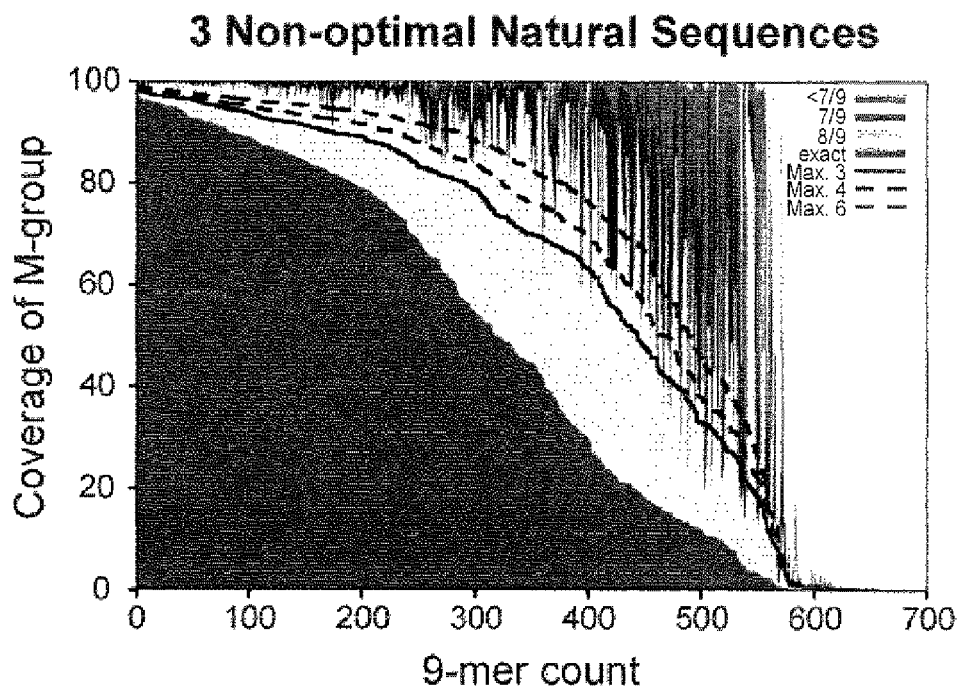
FIGS. 4A-4F. Coverage of M group sequences by different vaccine candidates, nine-mer by nine-mer. Each plot presents site-by-site coverage (i.e., for each nine-mer) of an M-group natural-sequence alignment by a single tri-valent vaccine candidate. Bars along the x-axis represent the proportion of sequences matched by the vaccine candidate for a given alignment position: 9/9 matches (in red), 8/9 (yellow), 7/9 (blue). Aligned 9-mers are sorted along the x-axis by exact-match coverage value. 656 positions include both the complete Gag and the central region of Nef. For each alignment position, the maximum possible matching value (i.e. the proportion of aligned sequences without gaps in that nine-mer) is shown in gray.
Figure 4B:
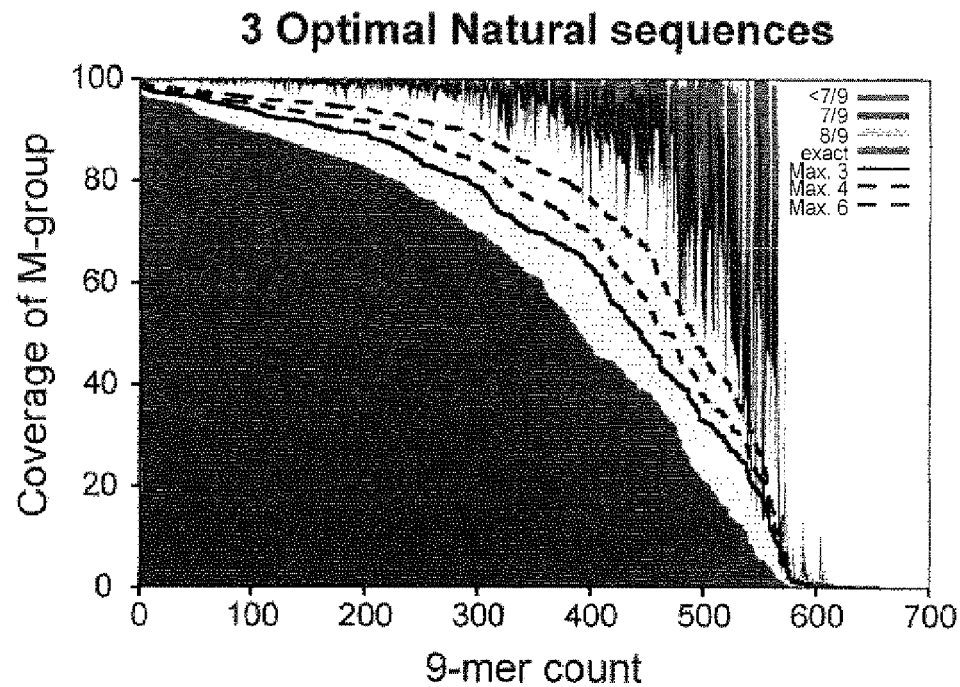
Figure 4C:
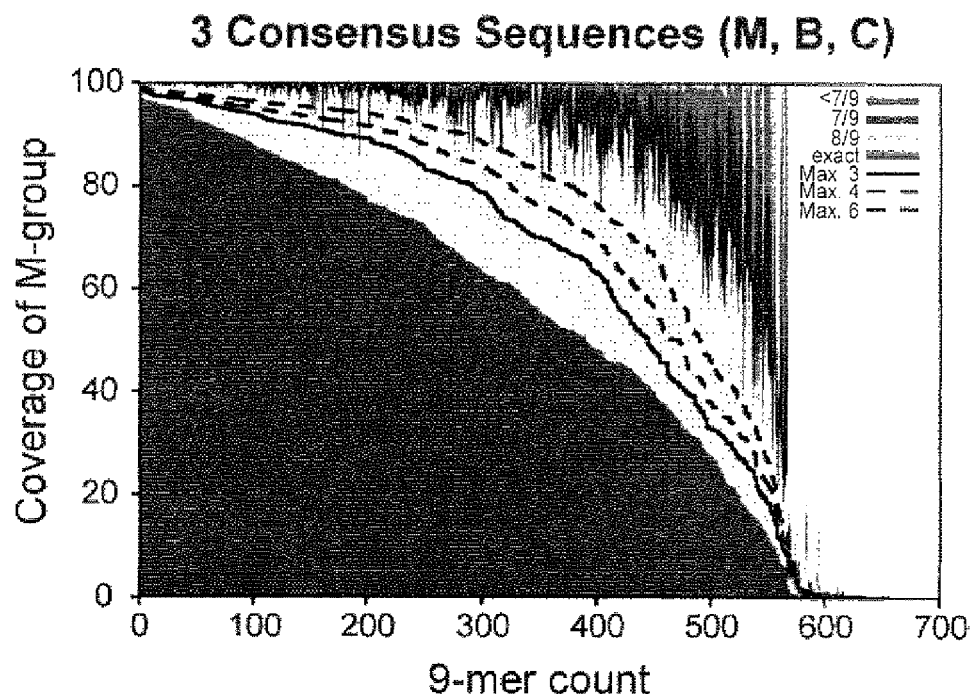
Figure 4D:
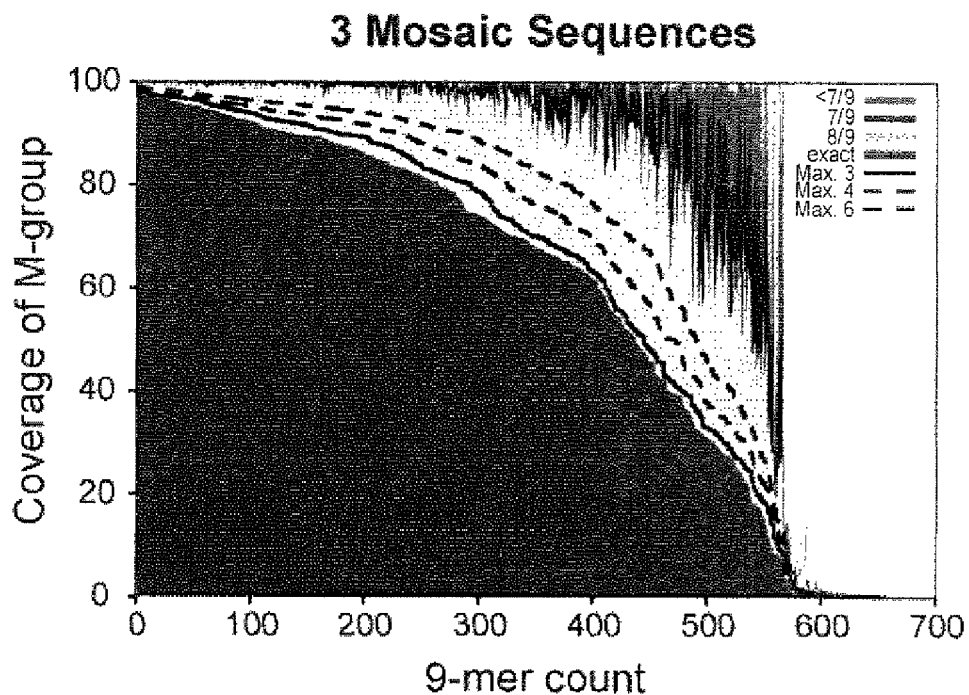
Figure 4E:
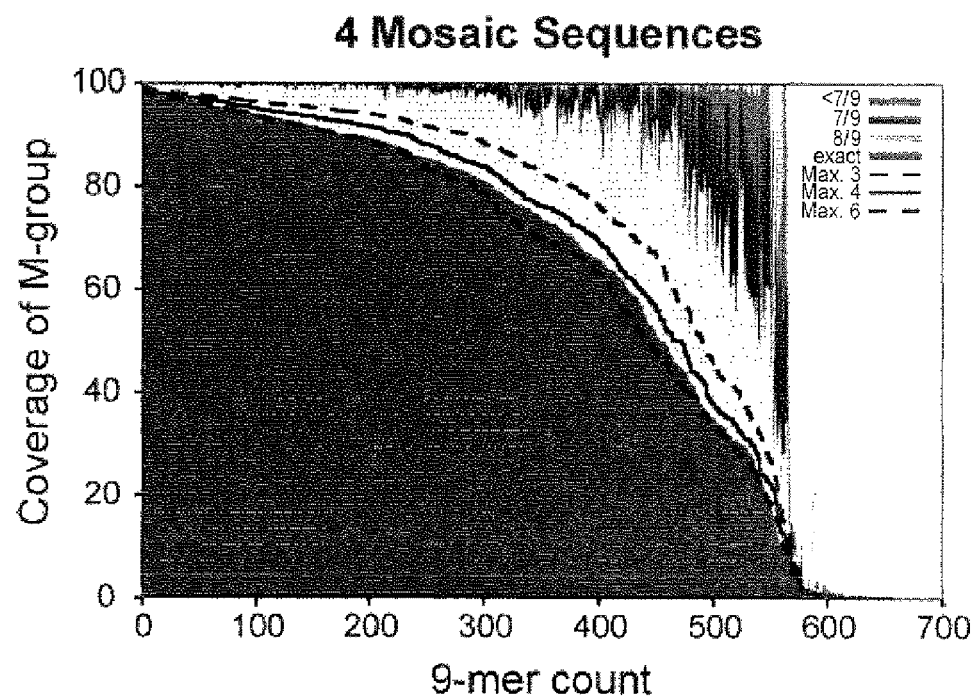
Figure 4F:
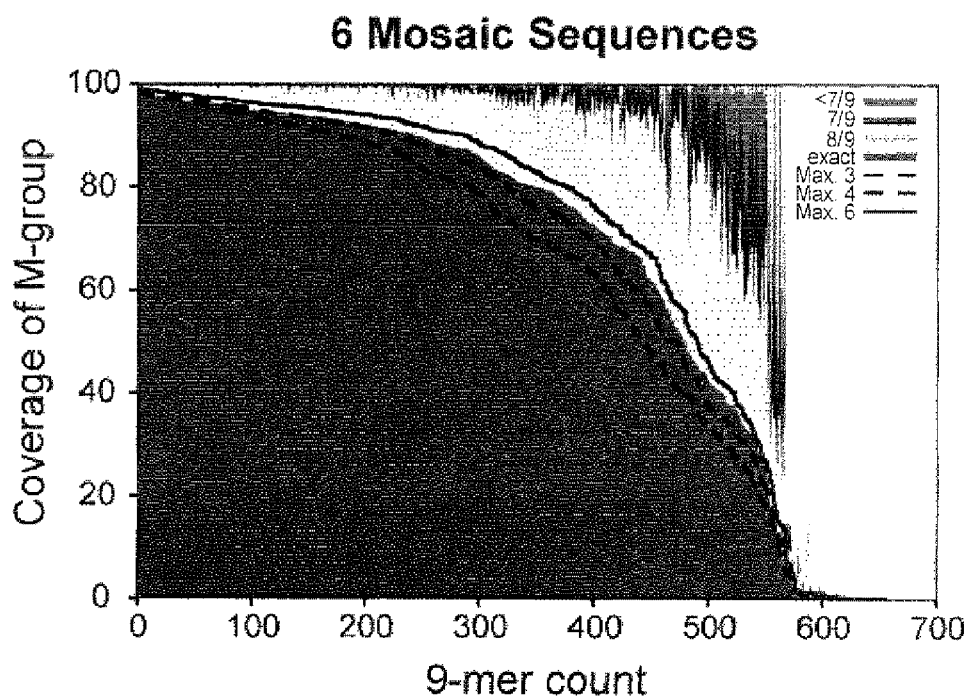

Selecting HIV protein regions for an initial mosaic vaccine. The initial design focused on protein regions meeting specific criteria: i) relatively low variability, ii) high levels of recognition in natural infection, iii) a high density of known epitopes and iv) either early responses upon infection or CD8+ T-cell responses associated with good outcomes in infected patients. First, an assessment was made of the level of 9-mer coverage achieved by mosaics for different HIV proteins (FIG. 3). For each protein, a set of four mosaics was generated using either the M group or the B- and C-subtypes alone; coverage was scored on the C subtype. Several results are notable: i) within-subtype optimization provides the best within-subtype coverage, but substantially poorer between-subtype coverage—nevertheless, B-subtype-optimized mosaics provide better C-subtype coverage than a single natural B subtype protein (Kong et al, J. Virol. 77:12764-72 (2003)); ii) Pol and Gag have the most potential to elicit broadly cross-reactive responses, whereas Rev, Tat, and Vpu have even fewer conserved 9-mers than the highly variable Env protein, iii) within-subtype coverage of M-group-optimized mosaic sets approached coverage of within-subtype optimized sets, particularly for more conserved proteins.

Gag and the central region of Nef meet the four criteria listed above. Nef is the HIV protein most frequently recognized by T-cells (Frahm et al, J. Virol. 78:2187-200 (2004)) and the target for the earliest response in natural infection (Lichterfeld et al, Aids 18:1383-92 (2004)). While overall it is variable (FIG. 3), its central region is as conserved as Gag (FIG. 1). It is not yet clear what optimum proteins for inclusion in a vaccine might be, and mosaics could be designed to maximize the potential coverage of even the most variable proteins (FIG. 3), but the prospects for global coverage are better for conserved proteins,. Improved vaccine protection in macaques has been demonstrated by adding Rev, Tat, and Nef to a vaccine containing Gag, Pol, and Env (Hel et al, J. Immunol. 176:85-96 (2006)), but this was in the context of homologous challenge, where variability was not an issue. The extreme variability of regulatory proteins in circulating virus populations may preclude cross-reactive responses; in terms of conservation, Pol, Gag (particularly p24) and the central region of Nef (HXB2 positions 65-149) are promising potential immunogens (FIGS. 1,3). Pol, however, is infrequently recognized during natural infection (Frahm et al, J. Virol. 78 2187-200 (2004)), so it was not included in the initial immunogen design. The conserved portion of Nef that were included contains the most highly recognized peptides in HIV-1 (Frahm et al, J. Virol. 78:2187-200 (2004)), but as a protein fragment, would not allow Nef's immune inhibitory functions (e.g HLA class I down-regulation (Blagoveshchenskaya, Cell 111:853-66 (2002))). Both Gag and Nef are densely packed with overlapping well-characterized CD8+ and CD4+ T-cell epitopes, presented by many different HLA molecules (http://.hiv.lanl.gov//content/immunology/maps/maps.html), and Gag-specific CD8+(Masemola et al, J. Virol. 78:3233-43 (2004)) and CD4+ (Oxenius et al, J. Infect. Dis. 189:1199-208 (2004)) T-cell responses have been associated with low viral set points in infected individuals (Masemola et al, J. Virol. 78:3233-43 (2004)).

To examine the potential impact of geographic variation and input sample size, a limited test was done using published subtype C sequences. The subtype C Gag data were divided into three sets of comparable size—two South African sets (Kiepiela et al, Nature 432:769-75 (2004)), and one non-South-African subtype C set. Mosaics were optimized independently on each of the sets, and the resulting mosaics were tested against all three sets. The coverage of 9-mers was slightly better for identical training and test sets (77-79% 9/9 coverage), but essentially equivalent when the training and test sets were the two different South African data sets (73-75%), or either of the South African sets and the non-South African C subtype sequences (74-76%). Thus between- and within-country coverage approximated within-clade coverage, and in this case no advantage to a country-specific C subtype mosaic design was found.

Designing mosaics for Gag and Nef and comparing vaccine strategies. To evaluate within- and between-subtype cross-reactivity for various vaccine design strategies, a calculation was made of the coverage they provided for natural M-Group sequences. The fraction of all 9-mers in the natural sequences that were perfectly matched by 9-mers in the vaccine antigens were computed, as well as those having 8/9 or 7/9 matching amino acids, since single (and sometimes double) substitutions within epitopes may retain cross-reactivity. FIG. 4 shows M group coverage per 9-mer in Gag and the central region of Nef for cocktails designed by various strategies: a) three non-optimal natural strains from the A, B, and C subtypes that have been used as vaccine antigens (Kong et al, J. Virol. 77:12764-72 (2003)); b) three natural strains that were computationally selected to give the best M group coverage; c) M group, B subtype, and C subtype consensus sequences; and, d,e,f three, four and six mosaic proteins. For cocktails of multiple strains, sets of k=3, k=4, and k=6, the mosaics clearly perform the best, and coverage approaches the upper bound for k strains. They are followed by optimally selected natural strains, the consensus protein cocktail, and finally, non-optimal natural strains. Allowing more antigens provides greater coverage, but gains for each addition are reduced as k increases (FIGS. 1 and 4).

Figure 5B:
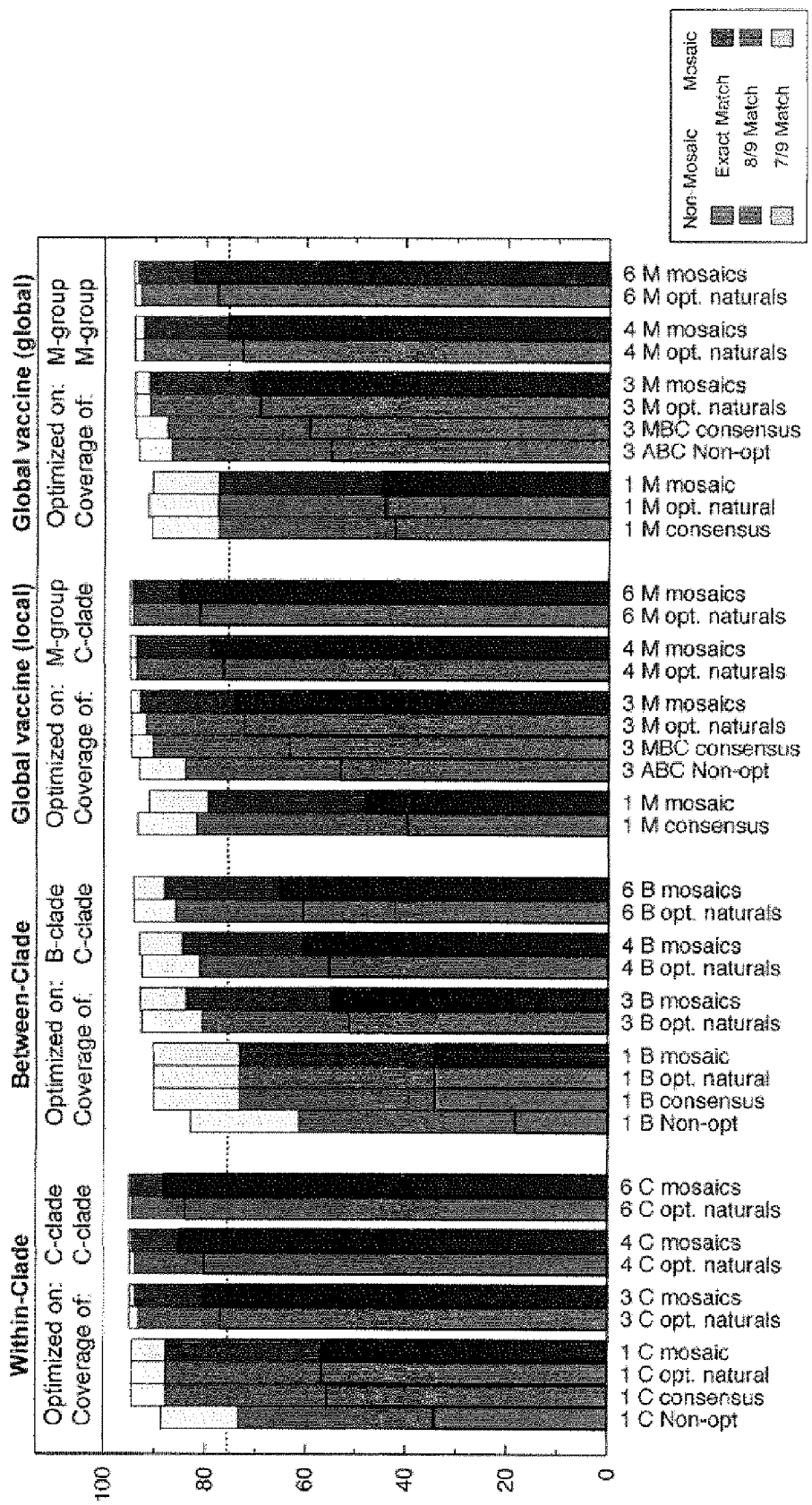
Figure 6A:
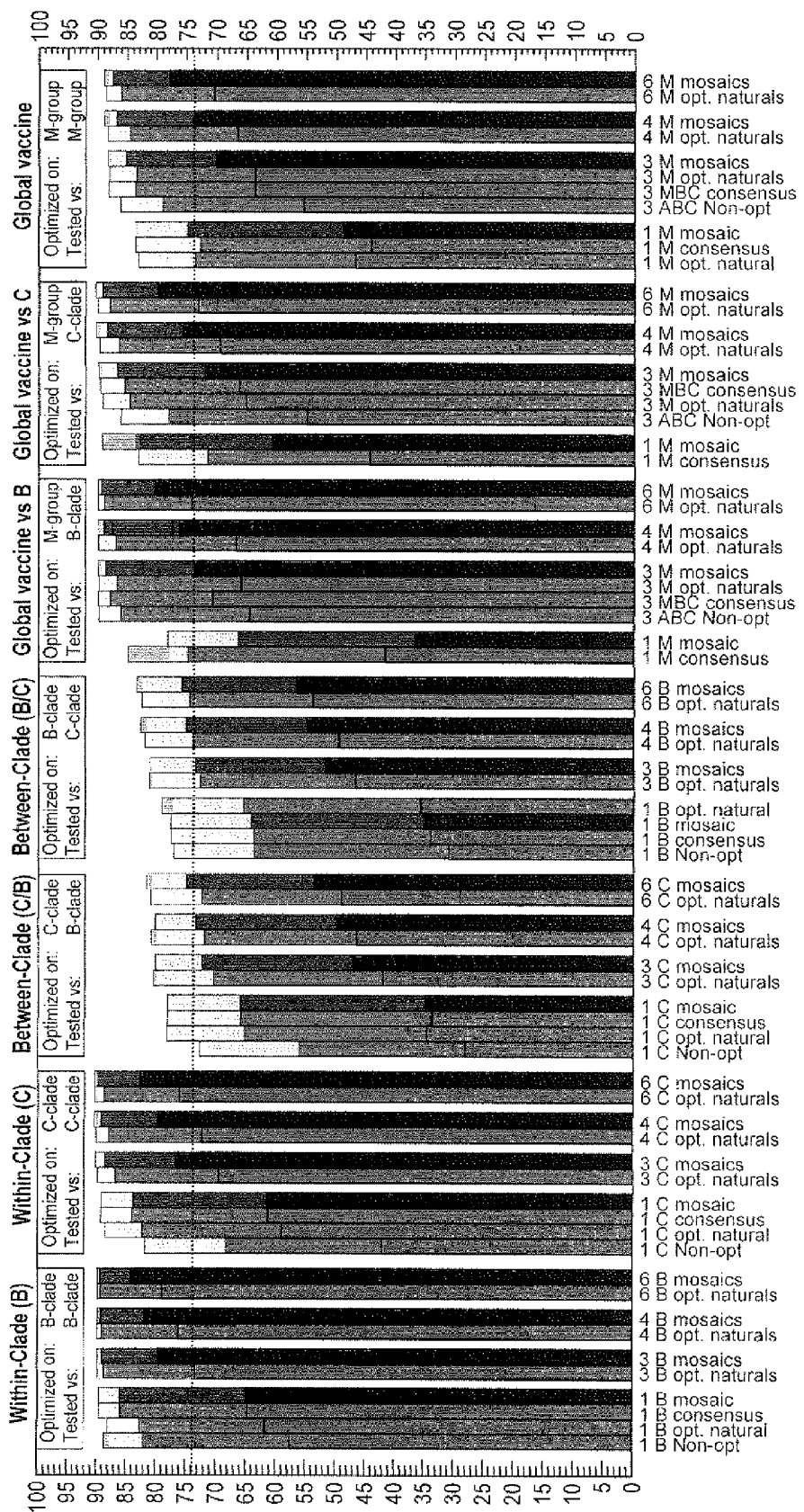
FIGS. 6A and 6B. Overall coverage of vaccine candidates: coverage of 9-mers in B-clade, C-clade, and M-group sequences using different input data sets for mosaic optimization, allowing different numbers of antigens, and comparing to different candidate vaccines. Exact (blue), 8/9 (one-off; red), and 7/9 (two-off; yellow) coverage was computed for mono- and polyvalent vaccine candidates for Gag (FIG. 6A) and Nef (core) (FIG. 6B) for seven test situations: within-clade (B- or C-clade-optimized candidates scored against the same clade), between-clade (B- or C-clade-optimized candidates scored against the other clade), global vaccine against single subtype (M-group-optimized candidates scored against B- or C-clade), global vaccine against global viruses (M-group-optimized candidates scored against all M-group sequences). Within each set of results, vaccine candidates are grouped by number of sequences in the cocktail (1-6); mosaic sequences are plotted with darker colors. "Non-opt" refers to a particular set of natural sequences previously proposed for a vaccine (Kong, W. P. et al. J Virol 77, 12764-72 (2003)); "mosaic" denotes sequences generated by the genetic algorithm; "opt. natural" denotes intact natural sequences selected for maximum 9-mer coverage; "MBC consensus" denotes a cocktail of 3 consensus sequences, for M-group, B-subtype, and C-subtype. A dashed line is shown at the level of exact-match M-group coverage for a 4-valent mosaic set optimized on the M-group.
Figure 6B:
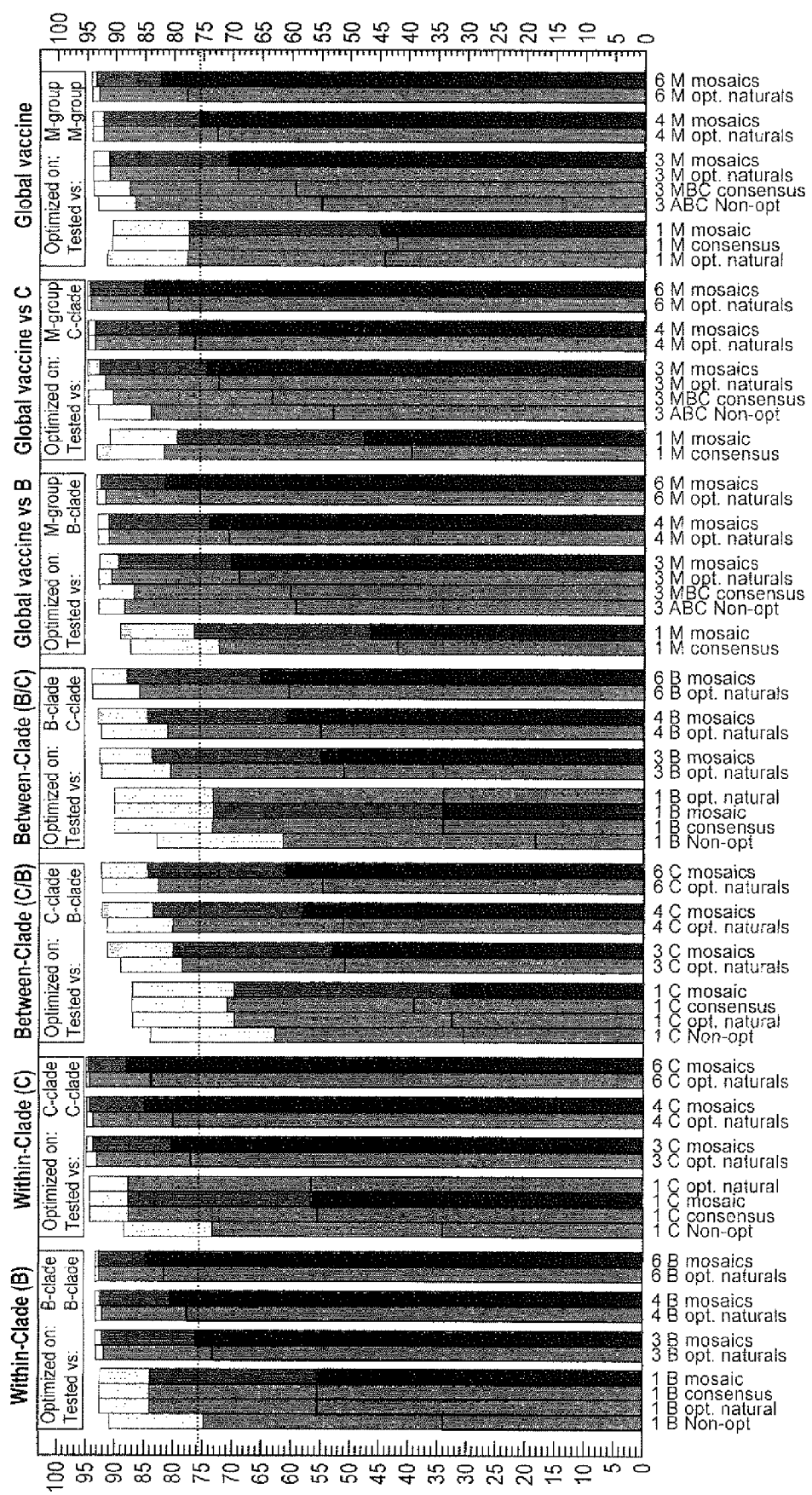

FIG. 5 summarizes total coverage for the different vaccine design strategies, from single proteins through combinations of mosaic proteins, and compares within-subtype optimization to M group optimization. The performance of a single mosaic is comparable to the best single natural strain or a consensus sequence. Although a single consensus sequence out-performs a single best natural strain, the optimized natural-sequence cocktail does better than the consensus cocktail: the consensus sequences are more similar to each other than are natural strains, and are therefore somewhat redundant. Including even just two mosaic variants, however, markedly increases coverage, and four and six mosaic proteins give progressively better coverage than polyvalent cocktails of natural or consensus strains. Within-subtype optimized mosaics perform best—with four mosaic antigens 80-85% of the 9-mers are perfectly matched—but between-subtype coverage of these sets falls off dramatically, to 50-60%. In contrast, mosaic proteins optimized using the full M group give coverage of approximately 75-80% for individual subtypes, comparable to the coverage of the M group as a whole (FIGS. 5 and 6). If imperfect 8/9 matches are allowed, both M group optimized and within-subtype optimized mosaics approach 90% coverage.

Figure 7B:
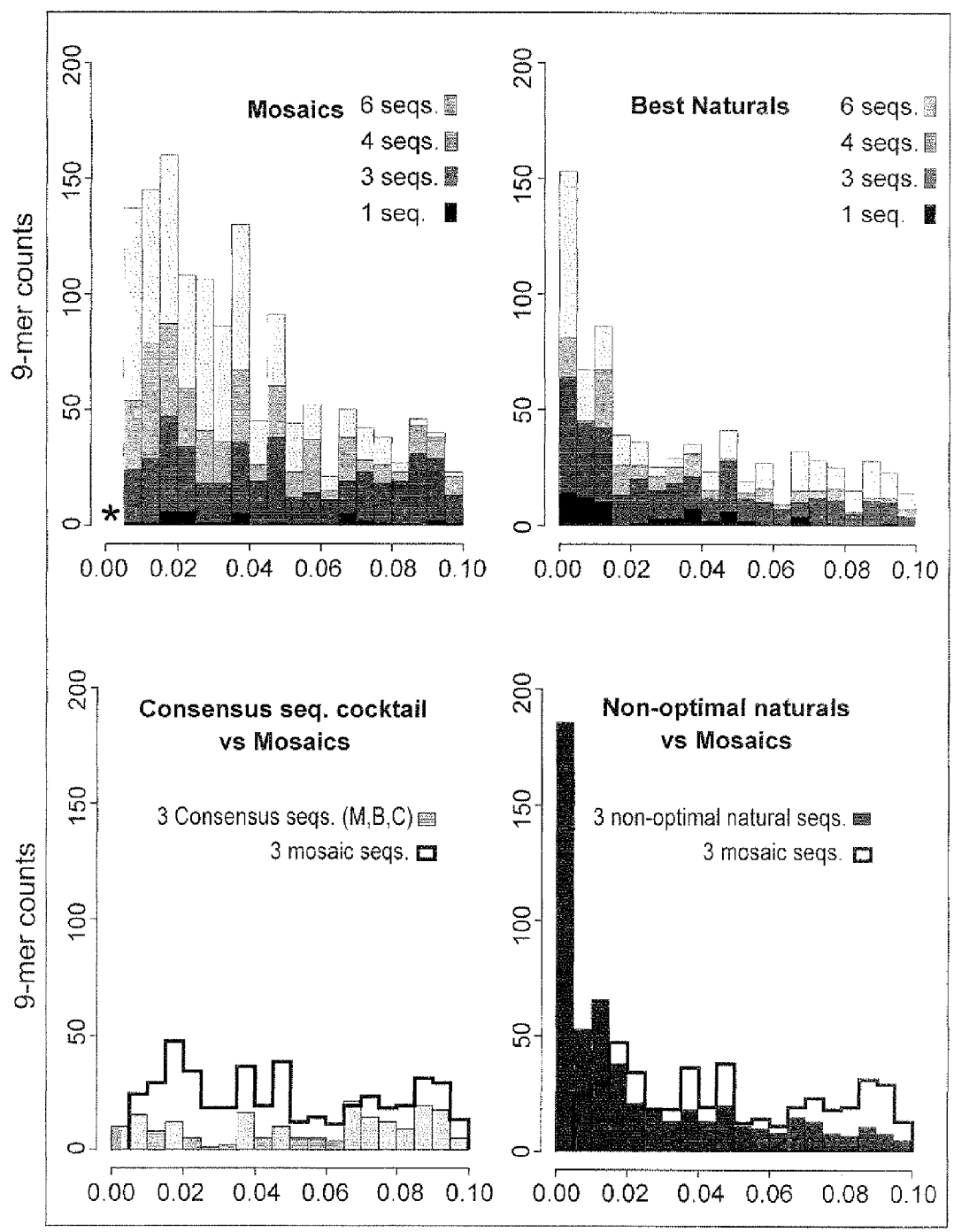

Since coverage is increased by adding progressively rarer 9-mers, and rare epitopes may be problematic (e.g., by inducing vaccine-specific immunodominant responses), an investigation was made of the frequency distribution of 9-mers in the vaccine constructs relative to the natural sequences from which they were generated. Most additional epitopes in a k=6 cocktail compared to a k=4 cocktail are low-frequency (<0.1, FIG. 7). Despite enhancing coverage, these epitopes are relatively rare, and thus responses they induce might draw away from vaccine responses to more common, thus more useful, epitopes. Natural-sequence cocktails actually have fewer occurrences of moderately low-frequency epitopes than mosaics, which accrue some lower frequency 9-mers as coverage is optimized. On the other hand, the mosaics exclude unique or very rare 9-mers, while natural strains generally contain 9-mers present in no other sequence. For example, natural M group Gag sequences had a median of 35 (range 0-148) unique 9-mers per sequence. Retention of HLA-anchor motifs was also explored, and anchor motif frequencies were found to be comparable between four mosaics and three natural strains. Natural antigens did exhibit an increase in number of motifs per antigen, possibly due to inclusion of strain-specific motifs (FIG. 8).

Figure 10:
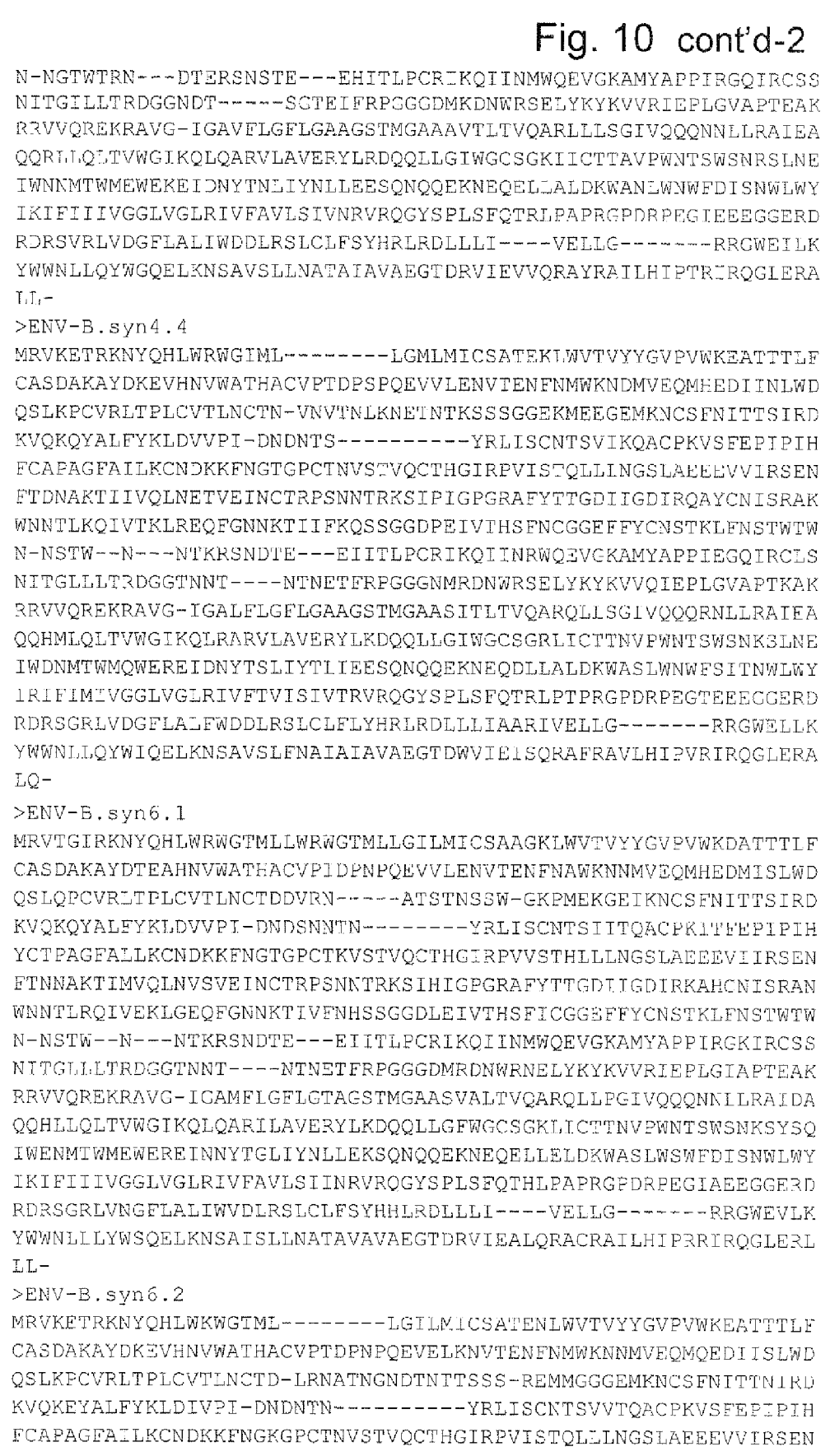

The increase in ever-rarer epitopes with increasing k, coupled with concerns about vaccination-point dilution and reagent development costs, resulted in the initial production of mosaic protein sets limited to 4 sequences (k=4), spanning Gag and the central region of Nef, optimized for subtype B, subtype C, and the M group (these sequences are included in FIG. 9; mosaic sets for Env and Pol are set forth in FIG. 10). Synthesis of various four-sequence Gag-Nef mosaics and initial antigenicity studies are underway. In the initial mosaic vaccine, targeted are just Gag and the center of the Nef protein, which are conserved enough to provide excellent global population coverage, and have the desirable properties described above in terms of natural responses (Bansal et al, Aids 19:241-50 (2005)). Additionally, including B subtype p24 variants in Elispot peptide mixtures to detect natural CTL responses to infection significantly enhanced both the number and the magnitude of responses detected supporting the idea that including variants of even the most conserved proteins will be useful. Finally, cocktails of proteins in a polyvalent HIV-1 vaccine given to rhesus macaques did not interfere with the development of robust responses to each antigen (Seaman et al, J. Virol. 79:2956-63 (2005)), and antigen cocktails did not produce antagonistic responses in murine models (Singh et al, J. Immunol. 169:6779-86 (2002)), indicating that antigenic mixtures are appropriate for T-cell vaccines.

Even with mosaics, variable proteins like Env have limited coverage of 9-mers, although mosaics improve coverage relative to natural strains. For example three M group natural proteins, one each selected from the A, B, and C clades, and currently under study for vaccine design (Seaman et al, J. Virol. 79:2956-63 (2005)) perfectly match only 39% of the 9-mers in M group proteins, and 65% have at least 8/9 matches. In contrast, three M group Env mosaics match 47% of 9-mers perfectly, and 70% have at least an 8/9 match. The code written to design polyvalent mosaic antigens is available, and could readily be applied to any input set of variable proteins, optimized for any desired number of antigens. The code also allows selection of optimal combinations of k natural strains, enabling rational selection of natural antigens for polyvalent vaccines, Included in Table 1 are the best natural strains for Gag and Nef population coverage of current database alignments.

---

Natural sequence cocktails having the best available 9-mer coverage for different genes, subtype sets, and numbers of sequences

---

Gag, B-subtype, 1 natural sequence

B.US.86.AD87__AF004394
Gag, B-subtype, 3 natural sequences

B.US.86.AD87__AF004394
B.US.97.Ac__06__AY247251
B.US.88.WR27__AF286365
Gag, B-subtype, 4 natural sequences B.US.86.AD87__AF004394
B.US.97.Ac__06__AY247251
B.US.__.R3__PDC1__AY206652
B.US.88.WR27__AF286365
Gag, B-subtype, 6 natural sequences B.CN.__.CNHN24__AY180905
B.US.86.AD87__AF004394
B.US.97.Ac__06__AY247251
B.US.__.P2__AY206654
B.US.__.R3__PDC1__AY206652
B.US.88.WR27__AF286365
Gag, C-subtype, 1 natural sequence C.IN.__.70177__AF533131
Gag, C-subtype, 3 natural sequences C.ZA.97.97ZA012
C.ZA.x.04ZASK161B1
C.IN.-.70177__AF533131
Gag, C-subtype, 4 natural sequences C.ZA.97.97ZA012
C.ZA.x.04ZASK142B1
C.ZA.x.04ZASK161B1
C.IN.__.70177__AF533131
Gag, C-subtype, 6 natural sequences C.ZA.97.97ZA012
C.ZA.x.04ZASK142B1
C.ZA.x.04ZASK161B1
C.BW.99.99BWMC168__AF443087
C.IN.__.70177__AF533131
C.IN.__.MYA1__AF533139
Gag, M-group, 1 natural sequence C.IN.__70177__AF533131
Gag, M-group, 3 natural sequences B.US.90.US2__AY173953
C.IN.-.70177__AF533131
15__01B.TH.99.99TH__R2399__AF530576
Gag, M-group, 4 natural sequences B.US.90.US2__AY173953
C.IN.__.70177__AF533131
C.IN.93.93IN999__AF067154
15__01B.TH.99.99TH__R2399__AF530576
Gag, M-group, 6 natural sequences C.ZA.x.04ZASK138B1
B.US.90.US2__AY173953
B.US.__.WT1__PDC1__AY206656
C.IN.__.70177__AF533131
C.IN.93.93IN999__AF067154
15__01B.TH.99.99TH__R2399__AF530576
Nef (central region), B-subtype, 1 natural sequence B.GB.94.028jh__94__1__NP__AF129346
Nef (central region), B-subtype, 3 natural sequences B.GB.94.028jh__94__1__NP__AF129346
B.KR.96.96KCS4__AY121471
B.FR.83.HXB2__K03455

-continued

Natural sequence cocktails having the best available 9-mer coverage for different genes, subtype sets, and numbers of sequences Nef (central region), B-subtype, 4 natural sequences B.GB.94.028jh_94_1_NP_AF129346
B.KR.96.96KCS4_AY121471
B.US.90.E90NEF_U43108
B.FR.83.HXB2_K03455

Nef (central region), B-subtype, 6 natural sequences

B.GB.94.028jh_94_1_NP_AF129346
B.KR.02.02HYJ3_AY121454
B.KR.96.96KCS4_AY121471
B.CN._.RL42_U71182
B.US.90.E90NEF_U43108
B.FR.83.HXB2_K03455

Nef (central region), C-subtype, 1 natural sequence

C.ZA.04.04ZASK139B1

Nef (central region), C-subtype, 3 natural sequences

C.ZA.04.04ZASK180B1
C.ZA.04.04ZASK139B1
C.ZA._.ZASW15_AF397568

Nef (central region), C-subtype, 4 natural sequences

C.ZA.97.ZA97004_AF529682
C.ZA.04.04ZASK180B1
C.ZA.04.04ZASK139B1
C.ZA._.ZASW15_AF397568

Nef (central region), C-subtype, 6 natural sequences

C.ZA.97.ZA97004_AF529682
C.ZA.00.1192M3M
C.ZA.04.04ZASK180B1
C.ZA.04.04ZASK139B1
C.04ZASK184B1
C.ZA._.ZASW15_AF397568

Nef (central region), M-group, 1 natural sequence

B.GB.94.028jh_94_1_NP_AF129346

Nef (central region), M-group, 3 natural sequences

02_AG.CM._.98CM1390_AY265107
C.ZA.03.03ZASK020B2
B.GB.94.028jh_94_1_NP_AF129346

Nef (central region), M-group, 4 natural sequences

02_AG.CM._.98CM1390_AY265107
01A1.MM.99.mCSW105_AB097872
C.ZA.03.03ZASK020B2
B.GB.94.028jh_94_1_NP_AF129346

Nef (central region), M-group, 6 natural sequences

02_AG.CM._.98CM1390_AY265107
01A1.MM.99.mCSW105_AB097872
C.ZA.03.03ZASK020B2
C.03ZASK111B1
B.GB.94.028jh_94_1_NP_AF129346
B.KR.01.01CWS2_AF462757

Summarizing, the above-described study focuses on the design of T-cell vaccine components to counter HIV diversity at the moment of infection, and to block viral escape routes and thereby minimize disease progression in infected individuals. The polyvalent mosaic protein strategy developed here for HIV-1 vaccine design could be applied to any variable protein, to other pathogens, and to other immunological problems. For example, incorporating a minimal number of variant peptides into T-cell response assays could markedly increase sensitivity without excessive cost: a set of k mosaic proteins provides the maximum coverage possible for k antigens.

A centralized (consensus or ancestral) gene and protein strategy has been proposed previously to address HIV diversity (Gaschen et al, Science 296:2354-2360 (2002)). Proof-of-concept for the use of artificial genes as immunogens has been demonstrated by the induction of both T and B cell responses to wild-type HIV-1 strains by group M consensus immunogens (Gaschen et al, Science 296:2354-2360 (2002), Gao et al, J. Virol. 79:1154-63 (2005), Doria-Rose et al, J. Virol. 79:11214-24 (2005), Weaver et al, J. Virol., in press)). The mosaic protein design improves on consensus or natural immunogen design by co-optimizing reagents for a polyclonal vaccine, excluding rare CD8+ T-cell epitopes, and incorporating variants that, by virtue of their frequency at the population level, are likely to be involved in escape pathways.

The mosaic antigens maximize the number of epitope-length variants that are present in a small, practical number of vaccine antigens. The decision was made to use multiple antigens that resemble native proteins, rather than linking sets of concatenated epitopes in a poly-epitope pseudo-protein (Hanke et al, Vaccine 16:426-35 (1998)), reasoning that in vivo processing of native-like vaccine antigens will more closely resemble processing in natural infection, and will also allow expanded coverage of overlapping epitopes. T-cell mosaic antigens would be best employed in the context of a strong polyvalent immune response; improvements in other areas of vaccine design and a combination of the best strategies, incorporating mosaic antigens to cover diversity, may ultimately enable an effective cross-reactive vaccine-induced immune response against HIV-1.

EXAMPLE 2

Group M consensus envelope and trivalent mosaic envelopes (both of which were designed by in silico modeling and are predicted to be superior than wildtype envelopes) will be compared to a monovalent wild-type envelope and trivalent wild-type transmitted envelopes in a 4 arm immunogenicity clinical trial. The mosaic antigens have been designed based on the current Los Alamos database, a set that includes more full length envelopes sampled globally from more than 2000 individuals with a large set of sequences of transmitted viruses primarily from the CHAVI database.

The selection of the natural strains to be used for the comparison is based on the following criteria: For the monovalent natural antigen, use will be made of the single transmitted virus that is the best choice in terms of providing coverage of potential T cell epitopes in the global database. The database is biased towards B clade envelopes, so the single best acute Env is a B clade representative. One A, one B and one C subtype transmitted virus Sequence is proposed for inclusion in the trivalent set, to compensate for the biases in sampling inherent in the global sequence collection, and to better reflect the circulating pandemic strains. The A and C natural sequences are those that optimally complement the best B clade sequence to provide potential epitope coverage of the database. Vaccine antigens have been selected from among available SGA sequenced acute samples, each representing a transmitted virus. Therefore, this study, although primarily a T cell study, will also provide important additional data regarding the ability of transmitted envelope vaccines to elicit neutralizing antibodies.

For a mosaic/consensus human trial, the following 4 arm trial is proposed, 20 people per group, with a negative control:
1) Con S (a well studied consensus of the consensus of each clade, based on the 2002 database; Con S has been extensively tested in animal models, and has theoretical coverage roughly comparable to a single mosaic.)
2) A 3 mosaic M group antigen set designed to, in combination, provide optimal global coverage of 9 amino acid long stretches in the database. Such 9-mers represent potential epitope coverage of the database. Unnatural 9-mers are excluded in mosaics, and rare variants minimized.

3) The optimal single best natural protein selected from sequences sampled from acutely infected patients with SGA sequences available; these sequences should correspond to viable, transmitted sequences. As in (2), this sequence will be selected to be the one that provides optimal 9-mer coverage of the database. The B clade currently dominates sampling for the sequence database, so the sequence with the best database coverage will be a B clade sequence.

4) The best natural strains from acute infection SGA sequences that in combination provide the best global coverage. (Note: the B and C dominate the M group sampling hence the code naturally selects one of each as the two best. Thus, the third complementary sequence was forced to be selected from an acute SGA A lade set, to counter this bias and better reflect the global epidemic).

5) Negative control buffer/saline

The current M group alignment in the HIV database was combined with all of the newer CHAVI sequences—this includes a total of 2020 sequences:
- 728 B clade
- 599 C clade
- 693 that are all other clades, circulating recombinant forms, and unique recombinants. This was used for the M group vaccine design.

This sampling is obviously skewed toward the B and C clade. As will be shown subsequently, the coverage of "potential epitopes" (9-mers) in other clades is still excellent.

The sequences

```
M consensus
>ConS
MRVRGIQRNCQHLWRWGTLILGMLMICSAAENLWVTVYYGVPVWKEANTT
LFCASDAKAYDTEVHNVWATHACVPTDPNPQEIVLENTENFNMWKNNMVE
QMHEDIISLWDQSLKPCVKLTPLCVTLNCTNVNVTNTTNNTEEKGEIKNC
SFNITTEIRDKKQKVYALFYRLDVVPIDDNNNNSSNYRLINCNTSAITQA
CPKVSFEPIPIHYCAPAGFAILKCNDKKFNGTGPCKNVSTVQCTHGIKPV
VSTQLLLNGSLAEEEIIRSENITNNAKTIIVQLNESVEINCTRPNNNTR
KSIRIGPGQAFYATGDIIGDIRQAHCNISGTKWNKTLQQVAKKLREHFNN
KTIIFKPSSGGDLEITTHSFNCRGEFFYCNTSGLFNSTWIGNGTKNNNNT
NDTITLPCRIKQIINMWQGVGQAMYAPPIEGKITCKSNITGLLLTRDGGN
NNTNETEIFRPGGGDMRDNWRSELYKYKVVKIEPLGVAPTKAKRRVVERE
KRAVGIGAVFLGFLGAAGSTMGAASITLTVQARQLLSGIVQQQSNLLRAI
EAQQHLLQLTVWGIKQLQARVLAVERYLKDQQLLGIWGCSGKLICTTTVP
WNSSWSNKSQDEIWDNMTWMEWEREINNYTDIIYSLIEFSQNQQEKNTYQ
ELLALDKWASLWNWFDITNWLWYIKIFIMIVGGLIGLRIVFAVLSIVNRV
RQGYSPLSFQTLIPNPRGPDRPEGIEEEGGEQDRDRSIRLVNGFLALAWD
DLRSLCLFSYHRLRDFILIAARTVELLGRKGLRRGWEALKYLWNLLQYWG
QELKNSAISLLDTTAIAVAEGTDRVIEVVQRACRAILNIPRRIRQGLERA
LL 3 mosaics
>M_mos_3_1
MRVKGIRKNYQHLWRWGTMLLGMLMICSAAEQLWVTVYYGVPVWRDAETT
LFCASDAKAYEREVHNVWATHACVPTDPNPQEIVLENVTEEFNMWKNNMV
DQMHEDIISLWDESLKPCVKLTPLCVTLNCTDVNVTKTNSTSWGMMEKGE
IKNCSFNMTTELRDKKQKVYALFYKLDIVPLEENDTISNSTYRLINCNTS
AITQACPKVTFEPIPIHYCTPAGFAILKCNDKKFNGTGPCKNVSTVQCTH
GIRPVVTTQLLLNGSLAEEEIIRSENLTNNAKTIIVQLNESVVINCTRP
NNNTRKSIRIGPGQTFYATGDIIGNIRQAHCNISREKWINTTRDVRKKLQ
EHFNKTIIFNSSSGGDLEITTHSFNCRGEFFYCNTSKLFNSVWGNSSNVT
KVNGTKVKETITLPCKIKQIINMWQEVGRAMYAPPIAGNITCKSNITGLL
LVRDGGNVTNNTEIFRPGGGNMKDNWRSELYKYKVVEIKPLGIAPTKAKR
RVVEREKRAVGLGAVFLGFLGAAGSTMGAASMTLTVQARQLLSGIVQQQS
NLLRAIEAQQHMLQLTVWGIKQLQARILAVERYLRDQQLLGIWGCSGKLI
CTTNVPWNSSWSNKSLDEIWNNMTWMQWEKEIDNYTSLIYTLIEESQNQQ
EKNEQDLLALDKWANLWNWFDISNWLWYIRIFIMIVGGLIGLRIVFAVLS
IVNRVRKGYSPLSFQTLTPNPRGPDRLGRIEEEGGEQDKDRSIRLVNGFL
ALAWDDLRNLCLFSYHRLRDLLLIVTRIVELLGRRGWLALKYLWNLLQYW
IQELKNSAVSLLNATAIAVAEGTDRVIEVVQRACRAILHIPRRIRQGLER
ALL >M_mos_3_2
MRVKETQMNWPNLWKWGTLILGLVIICSASDNLWVTVYYGVPVWKEATTT
LFCASDAKAYDTEVHNVWATYACVPTDPNPQEVVLGNVTENFNMWKNNMV
EQMHEDIISLWDQSLKPCVRLTPLCVTLNCSNANTTNTNSTEEIKNCSFN
ITTSIRDKVQKEYALFYKLDVVPIDNDNTSYRLISCNTSVITQACPKVSF
EPIPIHYCAPAGFAILKCKDKKFNGTGPCTNVSTVQCTHGIRPVVSTQLL
LNGSLAELEVVIRSENFTNNAKTIIVHLNKSVEINCTRPNNNTRKSIHIG
PGRAFYATGEIIGDIRQAHCNISRAKWNNTLKQIVKKLKEQFNKTIIFNQ
SSGGDPEITTHSFNCGGEFFYCNTSGLFNSTWNSTATQESNNTELNGNIT
LPCRIKQIVNMWQEVGKAMYAPPIRGQIRCSSNITGLILTRDGGNNNSTN
ETFRPGGGDMRDNWRSELYKYKVVKIEPLGVAPTKAKRRVVQREKRAVGT
IGAMFLGFLGAAGSTMGAASLTLTVQARLLLSGIVQQQNNLLRAIEAQQH
LLQLTVWGIKQLQARVLAVERYLKDQQLLGIWGCSGKLICTTTVPWNTSW
SNKSLNEIWDNMTWMEWEREIDNYTGLIYTLLEESQNQQEKNEQELLELD
KWASLWNWFDITKWLWYIKIFIMIVGGLVGLRIVFTVLSIVNRVRQGYSP
LSFQTHLPAPRGPDRPEGIEEEGGERDRDRSGRLVDGFLAIIWVDLRSLC
LFSYHQLRDFILIAARTVELLGHSSLKGLRRGWEALKYWWNLLQYWSQEL
KNSAISLLNTTAIVVAEGTDRIIEVLQRAGRAILHIPTRIRQGLERLLL >M_mos_3_3
MRVRGIQRNWPQWWIWGILGFWMLMICNVVGNLWVTVYYGVPVWKEAKTT
LFCASDAKAYEKEVHNVWATHACVPTDPSPQEVVLENVTENFNMWKNDMV
DQMHEDVISLWDQSLKPCVKLTHLCVTLNCTNATNTNYNNSTNVTSSMIG
EMKNCSFNITTEIRDKSRKEYALFYRLDIVPLNEQNSSEYRLINCNTSTI
```

```
TQACPKVSFDPIPIHYCAPAGYAILKCNNKTFNGTGPCNNVSTVQCTHGI

KPVVSTQLLLNGSLAEGEIIIRSENLTDNAKTIIVHLNESVEIVCTRPNN

NTRKSVRIGPGQAFYATGDIIGDIRQAHCNLSRTQWNNTLKQIVTKLREQ

FGNKTIVFNQSSGGDPEIVMHSFNCGGEFFYCNTTQLFNSTWENSNITQP

LTLNRTKGPNDTITLPCRIKQIINMWQGVGRAMYAPPIEGLIKCSSNITG

LLLTRDGGNNSETKTTETFRPGGGNMRDNWRNELYKYKVVQIEPLGVAPT

RAKRRVVEREKRAVGIGAVFLGFLGTAGSTMGAASITLTVQARQVLSGIV

QQQSNLLKAIEAQQHLLKLTVWGIKQLQTRVLAIERYLKDQQLLGLWGCS

GKLICTTAVPWNSSWSNKSQTDIWDNMTWMQWDREISNYTDTIYRLLEDS

QNQQEKNEKDLLALDSWKNLWNWFDITNWLWYIKIFIIIVGGLIGLRIIF

AVLSIVNRCRQGYSPLSLQTLIPNPRGPDRLGGIEEEGGEQDRDRSIRLV

SGFLALAWDDLRSLCLFSYHRLRDFILIVARAVELLGRSSLRGLQRGWEA

LKYLGSLVQYWGLELKKSAISLLIDTIAIAVAEGTDRIIEVIQRICRAIR

NIPRRIRQGFEAALL
```

Single optimal natural sequence selected from available acute SGA sequences:

```
>B.acute.Con.1059
MRVTEIRKNYLWRWGIMLLGMLMICSAAEQLWVTVYYGVPVWKEATTTLF

CASDAKAYTAEAHNVWATHACVPTDPNPQEVVLENVTENFNMWKNNMVEQ

MHEDIISLWDQSLKPCVKLTPLCVTLNCTDLANNTNLANNTNSSISSWEK

MEKGEIKNCSFNITTVIKDKIQKNYALFNRLDIVPIDDDDTNVTNNASYR

LISCNTSVITQACPKISFEPIPIHYCAPAGFAILKCNDKKFNGTGPCTNV

STVQCTHGIKPVVSTQLLLNGSLAEEEVVIRSENFTDNVKTIIVQLNESV

IINCTRPNNNTRKSITFGPGRAFYTTGDIIGDIRKAYCNISSTQWNNTLR

QIARRLREQFKDKTIVFNSSSGGDPEIVMHSFNCGGEFFYCNTTQLFNST

WNGNDTGEFNNTGKNITYITLPCRIKQIINMWQEVGKAMYAPPIAGQIRC

SSNITGILLTRDGGNSSEDKEIFRPEGGNMRDNWRSELYKYKVVKIEPLG

VAPTKAKRRVVQREKRAVGIGAVFLGFLGAAGSTMGAASMTLTVQARLLL

SGIVQQQNNLLRAIEAQQHLLQLTVWGIKQLQARVLAVERYLKDQQLLGI

WGCSGKLICTTAVPWNASWSNRSLDNIWNNMTWMEWDREINNYTNLIYNL

IEESQNQQEKNEQELLELDKWASLWNWFDITKWLWYIKIFIMIVGGLVGL

RIVFVILSIVNRVRQGYSPLSFQTHLPTPRGLDRHEGTEEEGGERDRDRS

GRLVDGFLTLIWIDLRSLCLFSYHRLRDLLLIVTRIVELLGRRGWEILKY

WWNLLQYWSQELKNSAVSLLNATAIAVAEGTDRIIEIVQRIFRAILHIPT

RIRQGLERALL
```

3 optimal natural selected from available acute samples, SGA sequences:

```
>B.acute.Con.1059
MRVTEIRKNYLWRWGIMLLGMLMICSAAEQLWVTVYYGVPVWKEATTTLF

CASDAKAYTAEAHNVWATHACVPTDPNPQEVVLENVTENFNMWKNNMVEQ

MHEDIISLWDQSLKPCVKLTPLCVTLNCTDLANNTNLANNTNSSISSWEK

MEKGEIKNCSFNITTVIKDKIQKNYALFNRLDIVPIDDDDTNVTNNASYR

LISCNTSVITQACPKISFEPIPIHYCAPAGFAILKCNDKKFNGTGPCTNV

STVQCTHGIKPVVSTQLLLNGSLAEEEVVIRSENFTDNVKTIIVQLNESV

IINCTRPNNNTRKSITFGPGRAFYTTGDIIGDIRKAYCNISSTQWNNTLR

QIARRLREQFKDKTIVFNSSSGGDPEIVMHSFNCGGEFFYCNTTQLFNST

WNGNDTGEFNNTCTKNITYITLPCRIKQIINMWQEVGKAMYAPPIAGQIR

CSSNITGILLTRDGGNSSEDKEIFRPEGGNMRDNWRSELYKYKVVKIEPL

GVAPTKAKRRVVQREKRAVGIGAVFLGFLGAAGSTMGAASMTLTVQARLL

LSGIVQQQNNLLRAIEAQQHLLQLTVWGIKQLQARVLAVERYLKDQQLLG

IWGCSGKLICTTAVPWNASWSNRSLDNIWNNMTWMEWDREINNYTNLIYN

LIEESQNQQEKNEQELLELDKWASLWNWFDITKWLWYIKIFIMIVGGLVG

LRIVFVILSIVNRVRQGYSPLSFQTHLPTPRGLDRHEGTEEEGGERDRDR

SGRLVDGFLTLIWIDLRSLCLFSYHRLRDLLLIVTRIVELLGRRGWEILK

YWWNLLQYWSQELKNSAVSLLNATAIAVAEGTDRIIEIVQRIFRAILHIP

TRIRQGLERALL

>C.acute.Con.0393
MRVRGILRNYQQWWIWGILGFWMLMICSVGGNLWVTVYYGVPVWREAKTT

LFCASDAKAYEREVHNVWATHACVPTDPNPQELFLENVTENFNMWKNDMV

DQMHEDIISLWDQSLKPCVKLTPLCVTLNCSNANITRNSTDGNTTRNSTA

TPSDTTNGEIKNCSFNITTELKDKKKKEYALFYRLDIVPLNEENSNFNEY

RLINCNTSAVTQACPKVSFDPIPIHYCAPAGYAILKCNNKTFNGTGPCNN

VSTVQCTHGIKPVVSTQLLLNGSLAIEEEIIIRSENLTNNAKTIIVHLKE

PVEIVCTRPNNNTRKSMRIGPGQTFYATDIIGDIRQASCNIDEKTWNNTL

NKVGEKLQEHFPNKTLNFAPSSGGDLEITTHSFNCRGEFFYCNTSKLFYK

TEFNSTTNSTITLQCRIKQITNMWQGVGRAMYAPPIEGNITCKSNITGLL

LTRDGGTNDSMTETFRPGGGDMRDNWRSELYKYKVVEIKPLGVAPTEAKR

RVVEREKRALTLGALFLGFLGTAGSTMGAASITLTVQARQLLSGIVQQQS

NLLKAIEAQQHLLQLTVWGIKQLQTRVLAIERYLQDQQLLGLWGCSGKLI

CTTAVPWNSSWSNKSQGEIWGNMTWMQWDREISNYTNTIYRLLEDSQIQQ

EKNEKDLLALDSWKNLWSWFSITNWLWYIKIFIMIVGGLIGLRIIFAVLS

IVNRVRQGYSPLPFQTLIPNPRGPDRLGRIEEEGGEQDRDRSIRLVNGFL

AIAWDDLRSLCLFSYHRLRDFILIAARAAELLGRSSLRGLQRGWEALKYL

GSLVQYWGLELKKSAISLLDTVAITVAEGTDRIIEVVQRICRAICNIPRR

IRQGFEAALQ
```

Coverage Comparison of the Four Vaccine Antigens.

Mosaics and naturals are optimized for the first red bar on the left for each vaccine (the total). The "total" represents all sequences, database+CHAVI. The "B" is the subset that are B clade, "C" the subset that are C clade, and "N" the remaining M group sequences that are not B or C (all other clades and recombinants). As B is most common, the single best natural is of course a B, and B thus has the best coverage for Nat.1. Con S, as expected, provides much more even coverage for all clades, and provides better coverage for all the groups except B clade. (Note: in a Con S Macaque study, the natural B was not selected to be optimal, and Con S had better coverage even within B clade than the B vaccine strain that had been used; this was reflected in the number of detected responses to heterogeneous B's. A difference here is that the natural B was selected to be the natural B clade sequence from acute infection that provides optimal coverage). Nat.3 gives good broad coverage, Mos.3 better. (See FIG. 11.)

The mosaics will minimize rare 9-mers but in Env they cannot be excluded or it is not possible to span certain really variable regions to make intact proteins. For all other HIV proteins tested, it was possible to exclude 9-mers that were found at 3 times or less. Still, the 3 best natural Envs contain more than twice the number of rare 9-mer variants relative to the 3 Env mosaics.

Figure 12:
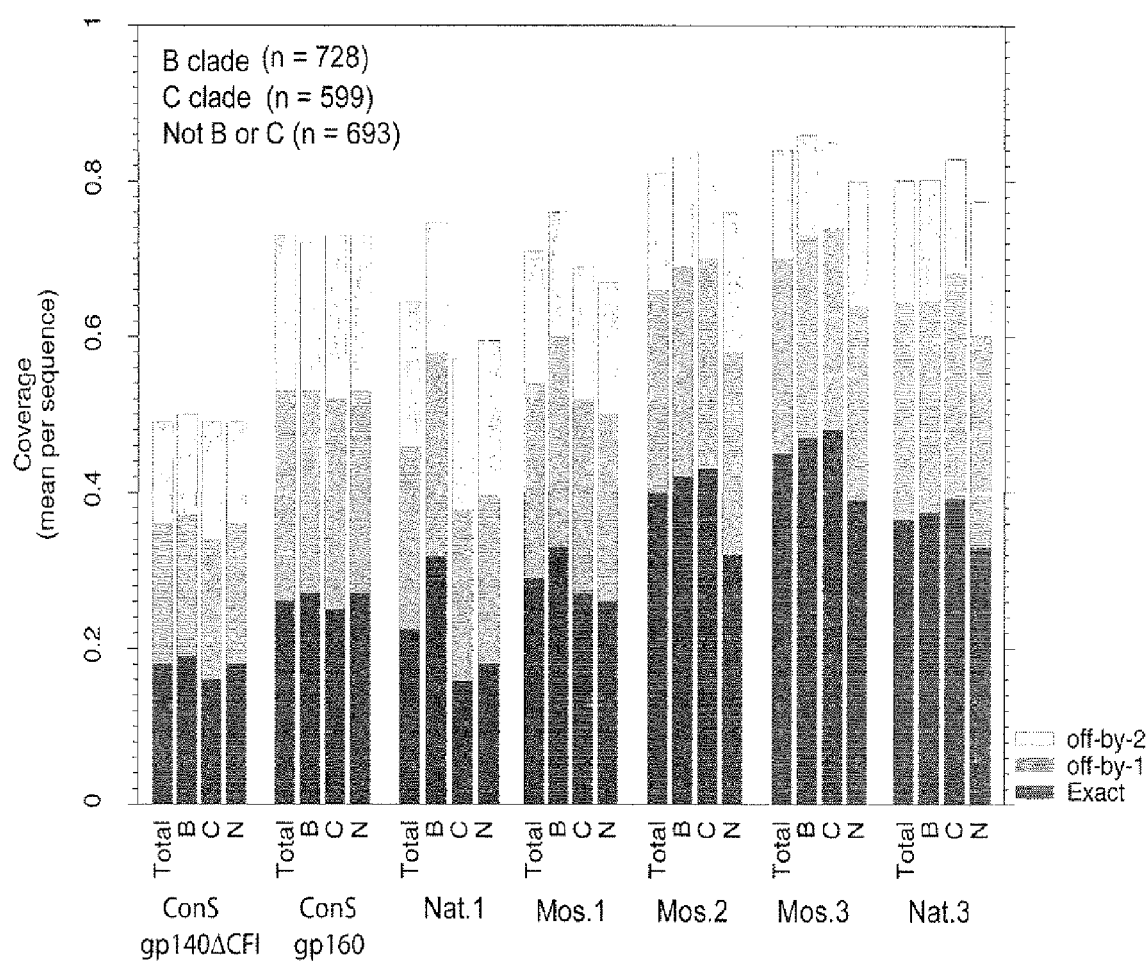
FIG. 12. Additional summaries of coverage.

FIG. 12 includes additional summaries of coverage; ConS gp160 contains quite a few conserved 9-mers that are missed in gp140DCFI, as one would expect. ConS provides slightly less coverage than a single mosaic, but it is already known that ConS works very well in macaques so serves as a good positive control. 1, 2, and 3 mosaics give increasingly better coverage, and Nat.3 is not as good as Mos.3.

Figure 13:
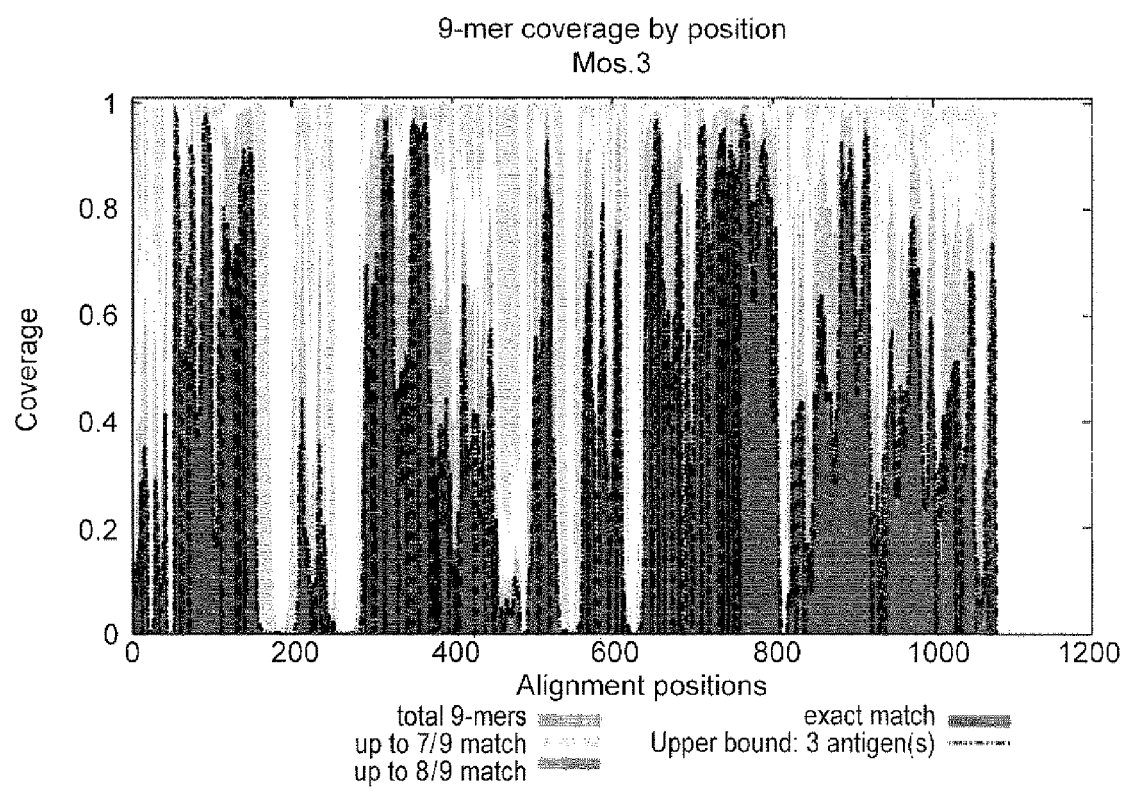
FIG. 13. 9-mer coverage by position (Mos.3 vaccine cocktail).
Figure 15A:
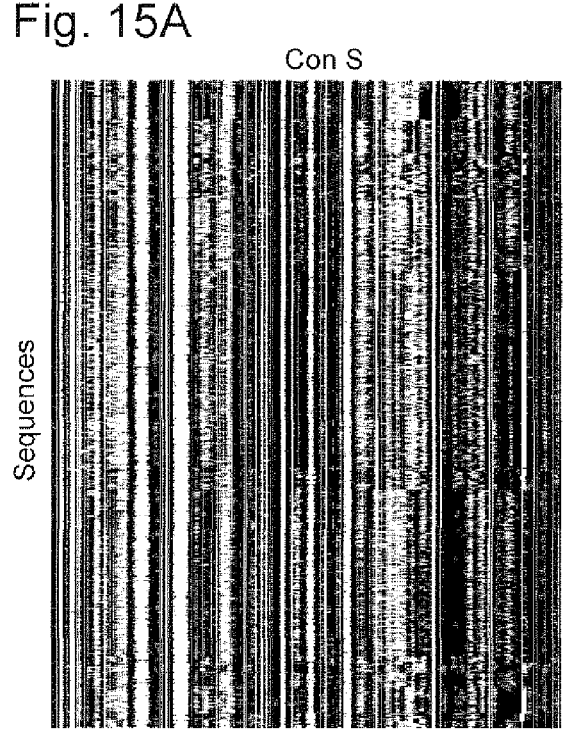
FIGS. 15A-15D. Plots mapping every amino acid in every sequence in the full database alignment.
Figure 15C:
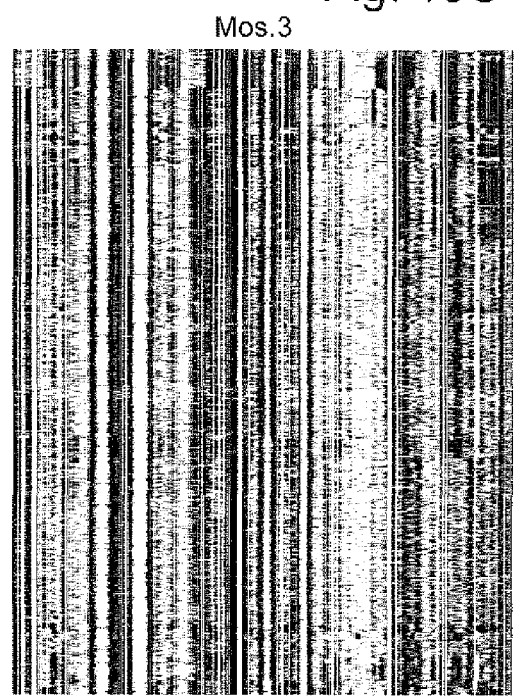
Figure 15B:
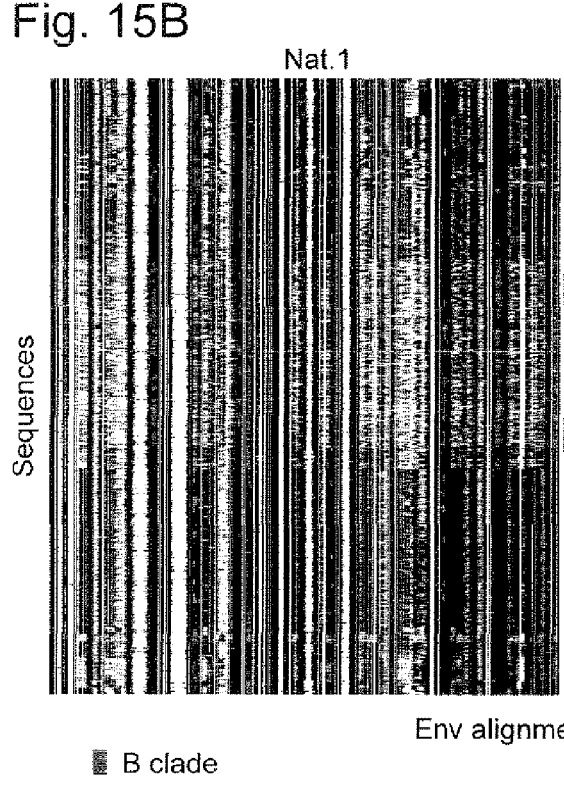
Figure 15D:
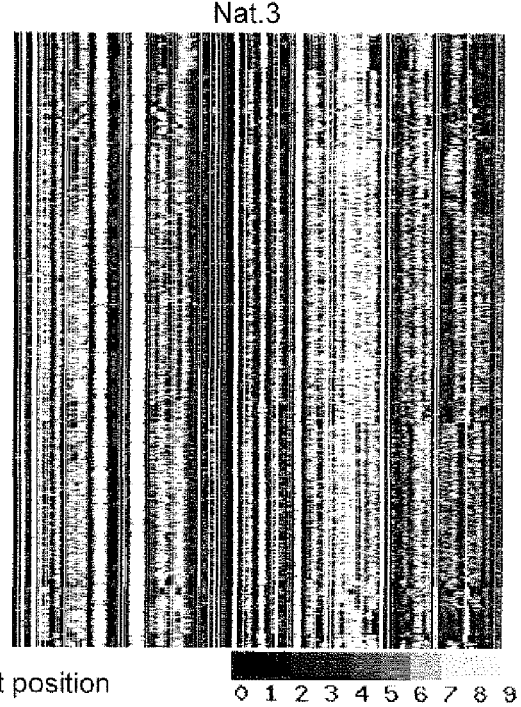

FIG. 13 is alignment dependent, and based on the database alignment (the tow plots above this are alignment independent). Each position represents the 9-mer it initiates as one moves across the protein. The upper bound (black dashed lined) is the sum of the frequencies of the three most common 9-mers starting from each position; it represents the maximal limit that could be achieved for coverage with 3 proteins, and this is not quite achievable in practice because there can be conflicts in a given position for overlapping 9-mers, although the 3 mosaic combination very nearly achieves it. The reason the "total 9-mers" shown in grey varies is because of insertions and deletions in the alignment.

Only the Mos.3 vaccine cocktail is shown in FIG. 13. However, all four vaccines resorted by coverage is shown in FIG. 14, where those positions that start the 9-mers that are best covered by the vaccine are moved to the left. The exact match line is left in all four plots for a reference point. Not only does Mos.3 (red) approach the maximum, but the orange and yellow near-matches that have potential for cross-reactivity are also improved in this vaccine cocktail as compared to the others.

The plots shown in FIG. 15 map every amino acid in every sequence in the full database alignment. A row of pixels is a sequence, a column is an alignment position. White patches are insertions to maintain the alignment. All 9-mers that encompass an amino acid are considered. If every 9-mer that spans the amino acid has a perfect match in the vaccine cocktail, the pixel is yellow, so yellow is good. If one is off, light orange, two off, darker orange . . . through no spanning 9-mer matches represented by black. Note: lots of yellow for 3 mosaics, relative to the other vaccines. There is a big patch of the most yellow for the B clade in Nat.1 as the single best natural is a B clade. Note, all those dark bits: in these regions the sequences in the database are different than any 9-mer in the vaccine, so cross-reactivity would be several limited.
Optmization using 9-mers.

Figure 16:
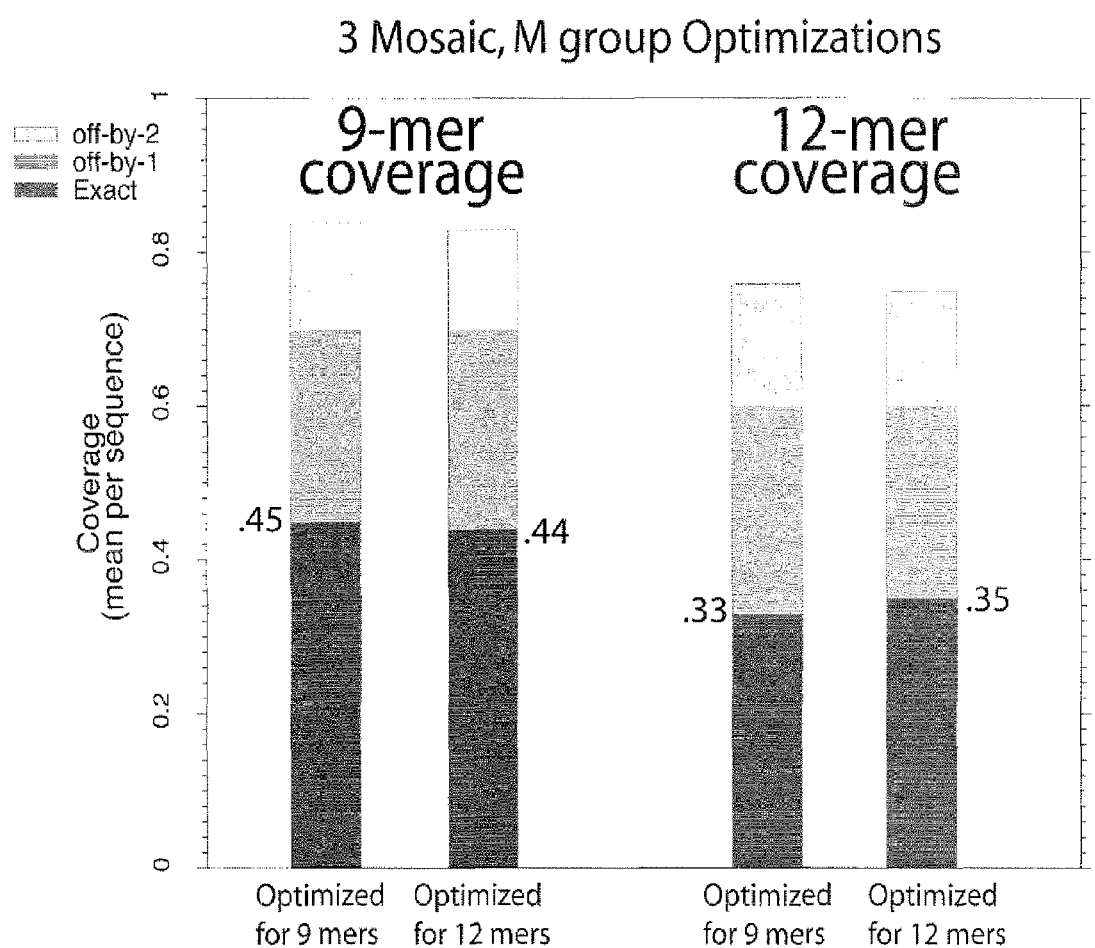
FIG. 16. 3 Mosaic, M group Optimizations.
Figure 20:
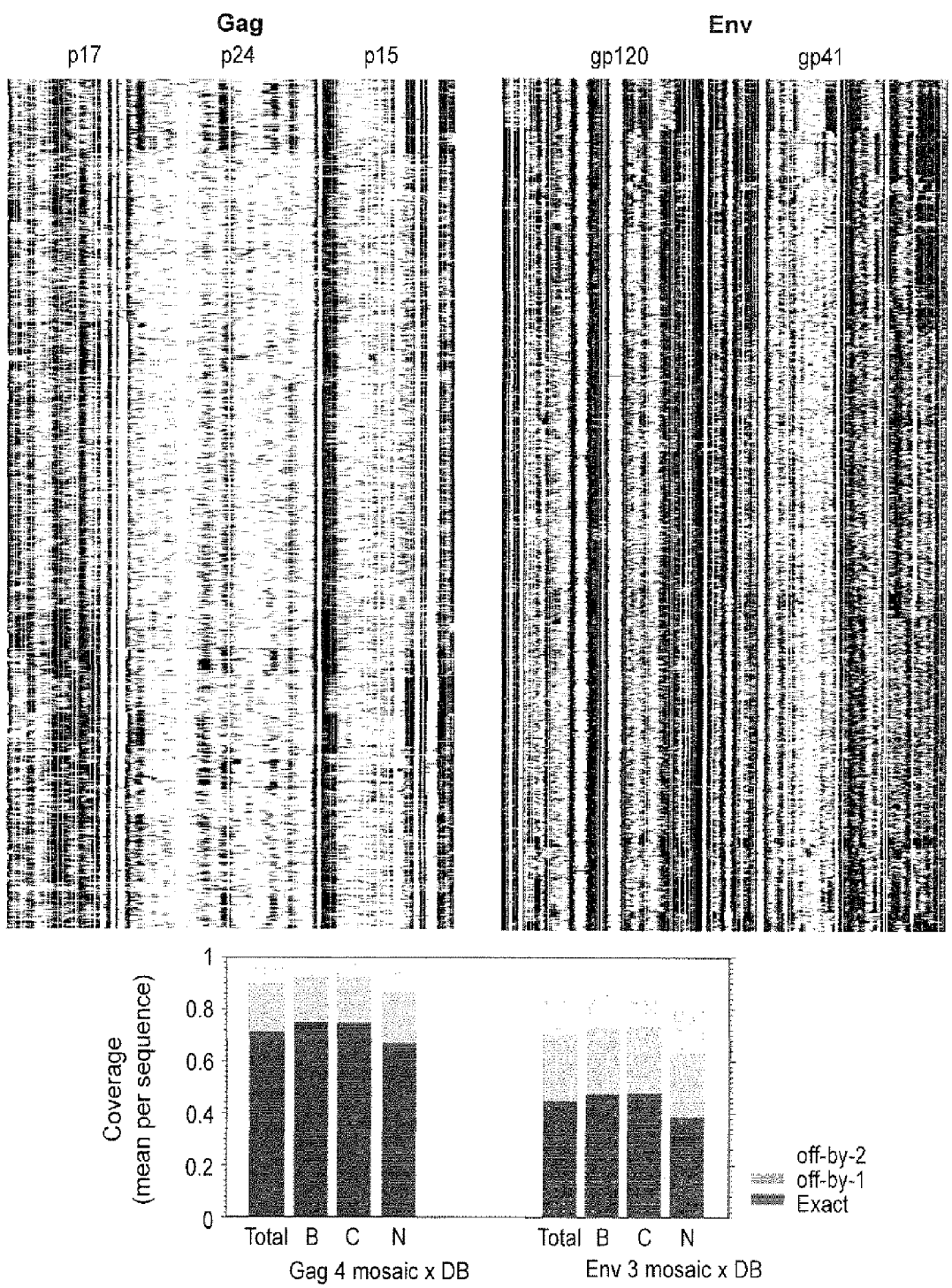
FIG. 20. Proposed vaccine mosaic coverage of Gag and Env.

9-mers were selected because that is the most common size of an optimal CD8+ T cell epitope. They range from 8-12, and optimal CD4+ T cell epitopes can be even be larger or smaller As it turns out, coverage of 9-mers is best when optimized for 9-mer coverage, but if optimization on a different size yields very little decrease in coverage for 9-mers. The same goes for all lengths, 8-12, the peak coverage is for the size selected but the coverage is excellent for other lengths, as the solutions are related. 9-versus 12-mers are shown in FIG. 16, 12 being the most extreme value one might reasonably consider. The coverage is nearly identical for 9-mers optimized for 9 or 12, or for 12-mers optimized for 9 or 12;it is 1-2% higher for the length selected for optimization. Naturally, 12-mers have fewer identities than 9-mers in general, because they are longer so it is harder to find a prefect match. A more comprehensive study was made of this for HIV proteins showing that the loss was consistently larger for 12-mers when optimized on 9 rather than vice versa, and that, in other proteins, this difference could be up to 4-5%. Thus, for Env the selection of 9-mers is less of a problem. Given all of the above, 9-mers were selected since this is the most common optimal CTL epitope length, and since optimal coverage of 9-mers provides approaching optimal coverage of other lengths.
Options for the 3 Best Natural Strains: Acute Transmission Cases SGA Sequences.

Use of all database sequences as a source for natural strains for vaccine cocktails was first explored, and then a comparison was made of that with selecting from a restricted group of just acute SGA sequences, essentially transmitted viruses. Essentially comparable coverage of the full database could be achieved by restricting to acute infection sequences. As these have other obvious advantages, they will be used for the natural sequences.

First, the exploration of coverage using the full database as a source for a natural cocktail. As noted above, the current M group Env one-seq-per-person data set is dominated by B clade infections, closely followed by C clade. Thus, the single best optimal natural selected by the vaccine design program to cover 9-mers in the (database+CHAVI) data set is a B. If one picks from among any sequence in the database, YU-2 comes up as the best single sequence. To get better representation of other clades, the best B was fixed, and then the next best sequence was added to complement YU-2, which is (logically) a C clade sequence, DU467. Those two were then fixed, and the third complement of the antigen was selected. (If the first two are not fixed, and the program is allowed to choose the third, it logically found a B/C recombinant, it has to be forced to select an A. It is believed that forcing the ABC set would improve global coverage, and partly counteract the B & C lade sampling bias among sequences.)

The optimal naturals from the database tend to harken back to older sequences; this is not surprising, as the older sequences tend to be more central in phylogenetic trees, and thus more similar other circulating strains. For this study, however, it is preferred to use more contemporary Envelope proteins sampled during acute infection and sequenced using SGA, as these sequences accurately reflect the transmitted virus. Given that constraint, it is still desired to optimize for 9-mer coverage, so that the cocktail of natural sequences is given the best chance for success in the comparison with mosaics. It turns out when this was done there was an extremely minor loss of coverage when comparing the trivalent cocktail selected from among acute SGA sequences to the trivalent antigen selected from the entire database, (in both cases optimizing for coverage the full database). Thus, by restricting the antigen cocktails to transmitted virus, coverage is not compromised. This alternative has several advantages. Most importantly, it enables a determination of the cross-reactive potential of antibodies generated from acute infection viruses used for the natural cocktail relative to consensus or mosaics as a secondary endpoint of interest, without compromising the primary endpoint focusing on a comparison of T-cell response breadth of coverage. A large set of B (113) and C (40) clade acute samples sequenced from CHAVI study is available, giving a large dataset from which to select an optimum combination. For the selection of the complementary sequence from the A clade, to complete the B and C in the trivalent vaccine. Several acute sequences were available.

Analysis of gp160 was undertaken that included the 8 subtype A gp160s, and also a subregion analysis was done with all 15 in V1-V4, to get an indication of whether or not more sequencing was required. Fortunately, one of the available full length sequences made an excellent complement to the B and C acutes, essentially as good as any of the others. This comparison indicated there was no particular need to do more sequencing at this time. It is believed that this is appropriate since with such a limited A baseline to select from, because the A sequence only needs to complement the choice of B and C lade strains, and many Bs and Cs were available from which to choose. Two of the patients from which the Nat.3 cocktail is derived are below. Nat. 1 is just the first one.

B patient 1059
Patient Sex-M
RiskFactor=PPD
Sample country=USA
Sample city=Long Beach, Calif.
Patient cohort=CA-UCSF
Patient health status=Acute
Viral Load=2,800,000
Infection country=USA
Sample date=03/26/98
C patient 0393
Fiebig Stage=4
Infection country=Malawi
Sample date=17-Jul-2003
Viral Load=12,048,485
Patient sex=F
CD4count=618 (measured 13 days after sequenced sample)
Patient age=23
STD=GUD,PID FIGS. 17 and 18 illustrate the minimal loss of coverage in selecting from acute SGA sequences, and a highlighter plot of each of the 3 patients env sequences, that shows that the consensus of each patient is equivalent to the most common strains, and thus an excellent estimate of the actual transmitted virus.

Why M Group and Not Clade Specific Coverage?

It is believed that it is important to strive for a global HIV vaccine, if at all possible, with exploratory methods such as these since many nations have multiclade epidemics, and people travel. While intra-clade coverage can definitely be gained by a within-clade optimized vaccine, the result of such a strategy would be dramatic loss of inter-clade coverage. The hope is that a multivalent mosaic could provide enough breadth to counter viruses of virtually any clades or recombinants. The compromise and benefit in terms of coverage for Env M group versus subtype-specific design is shown in FIG. 19.

Why Env?

This proof of concept study is well positioned to see differences in breadth of responses using Env as the test antigen. This is partly because of the theoretical considerations described herein (ENV has twice many conserved 9 mers in the mosaics relative to the best natural strain, and only half as many rare variants) and partly because of the prior animal studies. Env studies with a consensus versus natural in macaques showed a highly significant increase in breadth of responses: 3-4 fold more epitopes per Env protein were recognized (Santra et al, in press, PNAS). Env mosaics have shown an even more profound advantage in a mouse study (up to 10-fold over comparable numbers of natural antigens, manuscript in preparation in collaboration with the VRC). Based on this prior work, it makes sense to start with a small human trial testing the breadth of responses to Env. Ultimately, the hope is to apply the proof of concept gained with Env to a more conserved protein like a Gag where it may be possible to confer broadest protection. Gag gives outstanding coverage of the full M group. Tests of Gag and Nef are ongoing in macaque, using a 4 mosaic vaccine cocktail approach (see Example 3). A coverage comparison of macaque 4 mosaic Gag vaccine and proposed human is Env 3 mosaic vaccine against the current database is in FIG. 20. There is more theoretical potential for cross-reactivity with the Gag vaccine, but more progress has been made with Env in the animal models to date, so Env has the best foundation to justify moving forward. The three mosaic Env sequences described above and the sequences used in Example 3 are shown in FIG. 21.

DNA

The DNAs to be used will be in the form of the full gp160 Env. The gp160 would be in the PCMVR plasmid (Gary Nabel) and will be the identical plasmid used in all VRC DNA immunization trials. Dose is anticipated to be 4 mg. The following DNA constructs will be used:

- DNA optimal Wildtype Env transmitted/founder env (WT Env)
- DNA group M consensus Env (ConS Env)
- DNA Trivalent optimal wildtype transmitted/founder Env (WT Tri Env)
- DNA Trivalent Mosaic Env

NYVAC

NYVAC (vP866) is a recombinant poxvirus vector which has an 18 gene deletion versus wild-type virus. The NYVAC vector will be licensed from Sanofi-Pasteur and manufactured by a third party contractor and will be propagated on a CEF cell substrate. The Env construct expressed in NYVAC will be gp140C (entire Env with transmembrane and cytoplasmic domain deleted and gp41/gp120 cleavage site mutated) or will be a full gp160. The choice of construct design will depend on the ability to make the NYVAC with gp160 forms vs gp140. The dose of NYVAC is anticipated to be ~1×10^7 TCID50. The following NYVAC constructs will be used:

- NYVAC WT Env
- NYVAC ConS Env
- NYVAC Trivalent Native Env
- NYVAC Trivalent Mosaic Env Vaccinations will be given by intramuscular injection.

TABLE

Protocol Schema

| | | Injection schedule in weeks Dose | | | |
|---|---|---|---|---|---|
| Group | Number | 0 | 4 | 20 | 24 |
| 1 | 20 | DNA WT Env | DNA WT Env | NYVAC WT EnvA | NYVAC WT EnvA |
| | 4 | Placebo | Placebo | Placebo | Placebo |
| | | DNA ConS | DNA ConS | NYVAC ConS | NYVAC ConS |

TABLE-continued Protocol Schema

| Group | Number | \multicolumn{4}{c}{Injection schedule in weeks Dose} | | | |
|---|---|---|---|---|---|
| | | 0 | 4 | 20 | 24 |
| 2 | 20 | Env | Env | | |
| | 4 | Placebo | Placebo | Placebo | Placebo |
| | | DNA Trivalent | DNA Trivalent | NYVAC Trivalent | NYVAC Trivalent |
| 3 | 20 | Native Env | Native Env | Native Env | Native Env |
| | 4 | Placebo | Placebo | Placebo | Placebo |
| | | DNA Trivalent | DNA Trivalent | NYVAC Trivalent | NYVAC Trivalent |
| 4 | 20 | Mosaic Env | Mosaic Env | Mosaic Env | Mosaic Env |
| | 4 | Placebo | Placebo | Placebo | Placebo |
| Total | 96 (80/16) | | | | |

Participants:
Healthy, HIV-1-uninfected volunteers aged 18 to 50 years:
  80 vaccinees
  16 control recipients
  96 total participants
Design:
Randomized, placebo-controlled, double-blind trial
Duration per participant:
Approximately 12 months
Estimated total study duration:
Approximately 18 months

EXAMPLE 3

Construction of the plasmid DNA vaccines and recombinant vaccinia (rVV). Mosaic gag and nefgenes, group M consensus gag and nef genes were generated by converting amino acid sequences of said Gag and Nef, group M consensus Gag and Nef CON-S to nucleotide sequences using a strategy for optimal gene expression. For use as a DNA vaccine, mosaic gag and nef genes, group M consensus gag and nef genes were subcloned into WLV0001-AM DNA vaccine vector. Endotoxin-free plasmid DNA preparation were produced by Puresyn, Inc. (Malvern, Pa.) for the immunization of rhesus monkeys. For boosting recombinant vaccinia viruses expressing the individual mosaic gag and nef genes, group M consensus gag and nefgenes were generated. The methods used were as previously described (Liao et al, Virology 353:268-282 (2006); Earl, BioTechniques 23:1094-1097 (1997)).

Experimental groups and vaccination schedule. Three groups of rhesus monkeys were immunized with either 10 mg of the empty DNA vector plasmid (group 1, 6 monkeys), or 5 mg each of group M gag and nef plasmid DNA (group 2, 12 monkeys) or 1.25 mg each of 4 mosaic gag and 4 nef plasmid DNA (group 3, 12 monkeys) intramuscularly at Day O and Day 30. The monkeys will be boosted with the corresponding rVV expressing the initial immunizing immunogen ($10^9$ pfu/monkey) 5 month post-immunization with the $2^{nd}$ DNA immunization.

Myristoylation of Gag and Nef has a potential down regulation effect on immune responses and thus the myristoylation of Gag and Nef has been mutated in the sequences used in this study.

All documents and other information sources cited above are hereby incorporated in their entirety by reference.

SEQUENCE LISTING (222 sequences)

SEQ ID NO: 1 - protein, 85 aa, Human immunodeficiency virus 1
EVGFPVRPQVPLRPMTYKGALDLSHFLKEKGGLEGLIYSQKRQDILDLWVYHTQGYFPDWQNYTPGPGIRYPLTFGWCFKLVPVE

SEQ ID NO: 2 - protein, 85 aa, Human immunodeficiency virus 1
EVGFPVKPQVPLRPMTYKAAVDLSHFLKEKGGLEGLVYSQKRQDILDLWIYHTQGYFPDWQNYTPGPGTRFPLTFGWCFKLVPVD

SEQ ID NO: 3 - protein, 85 aa, Human immunodeficiency virus 1
EVGFPVTPQVPLRPMTYKGALDLSHFLREKGGLEGLIYSQKRQEILDLWVYHTQGYFPDWHNYTPGPGVRYPLTFGWCFKLVPVE

SEQ ID NO: 4 - protein, 85 aa, Human immunodeficiency virus 1
EVGFPVRPQVPLRPMTYKAALDLSHFLKEKGGLEGLIHSQRRQDILDLWVYHTQGFFPDWQNYTPGPGIRYPLTFGWCYKLVPVE

SEQ ID NO: 5 - protein, 85 aa, Human immunodeficiency virus 1
EVGFPVTPQVPLRPMTYKAAVDLSHFLREKGGLEGLIHSQKRQDILDLWIYHTQGYFPDWQNYTPGPGIRYPLTFGWCYKLVPVE

SEQ ID NO: 6 - protein, 85 aa, Human immunodeficiency virus 1
DVGFPVRPQIPLRPMTYKAALDLSHFLREKGGLEGLVYSQKRQDILDLWVYHTQGFFPDWQNYTPGPGTRFPLTFGWCFKLVPVD

SEQ ID NO: 7 - protein, 85 aa, Human immunodeficiency virus 1
EVGFPVRPQVPLRPMTYKGAVDLSHFLKEKGGLEGLIYSQKRQEILDLWVYHTQGYFPDWGNYTPGPGTRYPLTFGWCLKLVPVE

SEQ ID NO: 8 - protein, 85 aa, Human immunodeficiency virus 1
EVGFPVKPQVPLRPMTYKGALDLSHFLKEKGGLDGLIYSQRRQDILDLWVYNTQGYFPDWHNYTPGPGVRYPLTFGWCFKLVPVE

SEQ ID NO: 9 - protein, 85 aa, Human immunodeficiency virus 1
EVGFPIRPQVPLRPMTFKGALDLSHFLKEKGGLDGLIYSQKRQEILDLWVYHTQGYFPDWHNYTPGPGIRYPLCFGWCFKLVPVE

SEQ ID NO: 10 - protein, 85 aa, Human immunodeficiency virus 1
EVGFPVTPQVPLRPMTYKGAVDLSHFLKEQGGLEGLIYSQRRQDILDLWIYNTQGYFPDWQCYTPGPGVRFPLTFGWCFKLEPVD

SEQ ID NO: 11 - protein, 85 aa, Human immunodeficiency virus 1
EVGFPVKPQVPLRPMTYKAAVDLSHFLKEKGGLEGLIYSQKRQDILDLWIYHTQGYFPDWQNYTPGPGIRYPLTFGWCLKLVPVE

SEQ ID NO: 12 - protein, 85 aa, Human immunodeficiency virus 1
DVGFPVRPQVPLRPMTYKAALDLSHFLKEEGGLEGLIYSQQRQDILDLWVYHTQGFFPDWQNYTPGPGTRYPLTFGWCYKLVPVE

SEQ ID NO: 13 - protein, 85 aa, Human immunodeficiency virus 1
EVGFPVRPQIPLRPMTYKGALDLSHFLREKGGLEGLVYSQKRQDILDLWVHHTQGYFPDWGNYTPGPGTRFPLTFGWCFKLVPVD

SEQ ID NO: 14 - protein, 85 aa, Human immunodeficiency virus 1
EVGFPVRPQVPLRPMTYKGAFDLSHFLKDKGGLEGLIHSQKRQDILDLWVYNTQGYFPDWQNYTPGPGVRYPLTFGWCFKLVPLE

SEQ ID NO: 15 - protein, 85 aa, Human immunodeficiency virus 1
EVGFPVRPQVPLRPMTYKAAFDLSFFLKEKGGLEGLIYSKKRQEILDLWVYHTQGFFPDWQNYTPGPGVRYPLTFGWCFKLVPVD

SEQ ID NO: 16 - protein, 85 aa, Human immunodeficiency virus 1
EVGFPVTPQVPLRPMTFKGAFDLGFFLKEKGGLDGLIYSKKRQDILDLWVYHTQGYFPDWQNYTPGPGVRYPLTFGWCYKLVPVD

SEQ ID NO: 17 - protein, 85 aa, Human immunodeficiency virus 1
EVGFPVKPQVPLRPMTYKAAFDLSFFLKDKGGLEGLIWSKKRQEILDLWVYHTQGFFPDWQNYTPGPGIRYPLTFGWPFKLVPVD

SEQ ID NO: 18 - protein, 85 aa, Human immunodeficiency virus 1
EVGFPVRPQVPLRPMTYKGAFDLSFFLKEKGGLEGLIYSKKRQEILDLWVYNTQGFFPDWHNYTPGPGVRFPLTFGWCFKLVPVD

SEQ ID NO: 19 - protein, 85 aa, Human immunodeficiency virus 1
EVGFPVRPQVPLRPMTYKGAFDLSFFLKEKGGLEGLIWSKKRQEILDLWVYNTQGYFPDWQCYTPGPGVRFPLTFGWCFKLVPVD

SEQ ID NO: 20 - protein, 85 aa, Human immunodeficiency virus 1
DVGFPVRPQVPVRPMTYKAAFDLSFFLKDKGGLEGLIHSKRRQDILDLWVYNTQGFFPDWHNYTPGPGIRYPLTFGWCFKLVPVD

SEQ ID NO: 21 - protein, 85 aa, Human immunodeficiency virus 1
EVGFPVKPQVPLRPMTYKAAVDLSFFLKEKGGLEGLIYSKKRQEILDLWVYHTQGFFPDWQNYTPGPGTRYPLTFGWPFKLVPVD

SEQ ID NO: 22 - protein, 85 aa, Human immunodeficiency virus 1; identical to SEQ ID NO: 16

SEQ ID NO: 23 - protein, 85 aa, Human immunodeficiency virus 1
DVGFPVRPQVPLRPMTYKGAFDLSFFLKEKGGLDGLIYSKKRQEILDLWVYNTQGYFPDWQCYTPGPGVRYPLTFGWCYKLVPVD

SEQ ID NO: 24 - protein, 85 aa, Human immunodeficiency virus 1
EVGFPVKPQVPVRPMTYKAAFDLSFFLKDKGGLEGLIWSKKRQEILDLWVYHTQGFFPDWQNYTPGPGIRYPLTFGWCFKLVPVD

SEQ ID NO: 25 - protein, 85 aa, Human immunodeficiency virus 1
EVGFPVKPQVPLRPMTFKGAFDLGFFLKEKGGLEGLIYSKQRQDILDLWVYHTQGFFPDWHNYTPGPGVRLPLTFGWCFKLVPVD

SEQ ID NO: 26 - protein, 85 aa, Human immunodeficiency virus 1
GVGFPVRPQVPVRPMTYKAAFDLGFFLKDKGGLEGLIYSKKRQDILDLWVYNTQGFFPDWQNYTPGPGVRFPLTFGWCFKLVPVD

SEQ ID NO: 27 - protein, 85 aa, Human immunodeficiency virus 1
EVGFPVTPQVPLRPMTYKAAVDLSWFLKEKGGLDGLIYSRKRQEILDLWVHHTQGFFPDWQNYTPGPGTRFPLTFGWCFKLVPVD

SEQ ID NO: 28 - protein, 85 aa, Human immunodeficiency virus 1
EVGFPVRPQVPVRPMTYKGAVDLSFFLKEKGGLEGLIHSKRRQDILDLWVYHTQGYFPDWQNYTPGPGTRYPLTFGWPFKLVPVD

SEQ ID NO: 29 - protein, 85 aa, Human immunodeficiency virus 1
EVGFPVRPQVPLRPMTYKGALDLSHFLKEKGGLEGLIYSKKRQEILDLWVYHTQGYFPDWQNYTPGPGVRYPLTFGWCFKLVPVD

SEQ ID NO: 30 - protein, 85 aa, Human immunodeficiency virus 1
DVGFPVRPQVPLRPMTYKAAVDLSHFLKEKGGLEGLVYSQKRQDILDLWVYHTQGFFPDWQNYTPGPGVRYPLTFGWCYKLVPVD

SEQ ID NO: 31 - protein, 85 aa, Human immunodeficiency virus 1
EVGFPVRPQVPVRPMTYKGAFDLSFFLKEKGGLEGLIYSKKRQEILDLWVYHTQGYFPDWHNYTPGPGTRFPLTFGWCFKLVPVD

SEQ ID NO: 32 - protein, 85 aa, Human immunodeficiency virus 1
EVGFPVKPQVPLRPMTYKGALDLSHFLKEKGGLDGLIYSKKRQDILDLWVYNTQGYFPDWQNYTPGPGIRYPLTFGWCFKLVPVE

SEQ ID NO: 33 - protein, 85 aa, Human immunodeficiency virus 1
EVGFPVTPQVPLRPMTFKGAFDLGFFLKEKGGLEGLIYSKKRQEILDLWVYHTQGFFPDWQNYTPGPGTRYPLCFGWCFKLVPVE

SEQ ID NO: 34 - protein, 85 aa, Human immunodeficiency virus 1
EVGFPVKPQVPLRPMTYKAAVDLSHFLKEKGGLEGLVYSQKRQDILDLWVYHTQGYFPDWQNYTPGPGIRYPLTFGWCYKLVPVD

SEQ ID NO: 35 - protein, 85 aa, Human immunodeficiency virus 1
DVGFPVRPQVPLRPMTYKGALDLSHFLKEEGGLEGLIYSQKRQEILDLWVYNTQGYFPDWQNYTPGPGVRYPLTFGWCFKLVPVD

SEQ ID NO: 36 - protein, 85 aa, Human immunodeficiency virus 1
EVGFPVRPQVPVRPMTYKGAFDLSFFLKEKGGLDGLIYSKKRQDILDLWVYNTQGFFPDWHNYTPGPGTRFPLTFGWCFELVPVD

SEQ ID NO: 37 - protein, 85 aa, Human immunodeficiency virus 1
EVGFPVRPQVPTRPMTYKGAVDLSHFLKEKGGLEGLVYSQKRQDILDLWVHHTQGFFPDWQNYTPGPGTRYPLTFGWPFKLVPVD

SEQ ID NO: 38 - protein, 85 aa, Human immunodeficiency virus 1
DVGFPVRPQVPVRPMTYKAAFDLSFFLREKGGLDGLIYSKKRQDILDLWVYNTQGYFPDWQNYTPGPGVRFPLTFGWCFELVPVD

SEQ ID NO: 39 - protein, 85 aa, Human immunodeficiency virus 1
NVGFPVRPQVPLRPMTFKGAFDLGFFLKEKGGLEGLIYSKKRQEILDLWVYHTQGYFPDWHNYTPGPGTRFPLTFGWCFKLVPVE

SEQ ID NO: 40 - protein, 85 aa, Human immunodeficiency virus 1
EVGFPVTPQVPLRPMTYKGAFDLSFFLKEKGGLDGLIYSRKRQEILDLWVYNTQGFFPDWQNYTPGPGIRYPLTFGWCFKLVPMD

SEQ ID NO: 41 - protein, 85 aa, Human immunodeficiency virus 1
EVGFPVKPQVPLRPMTYKAAVDLSHFLREKGGLEGLIHSQRRQDILDLWIYHTQGYFPDWQCYTPGPGVRYPLTFGWCYKLVPVD

SEQ ID NO: 42 - protein, 85 aa, Human immunodeficiency virus 1
GVGFPVRPQIPLRPMTYKGALDLSHFLKEEGGLEGLIYSQKRQDILDLWVYHTQGFFPDWHNYTPGPGIRYPLCFGWCFKLVPVD

SEQ ID NO: 43 - protein, 500 aa, Human immunodeficiency virus 1
MGARASVLSGGELDRWEKIRLRPGGKKKYKLKHIVWASRELERFAVNPGLLETSEGCRQILGQLQPSLQTGSEELRSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 44 - protein, 500 aa, Human immunodeficiency virus 1
MGARASILSGGELDRWEKIRLRPGGKKQYRLKHIVWASRELERFAINPGLLETSDGCRQILGQLQPALQTGSEELKSLFNTVATLYCVHQRIDVKDTKEALDKIEEEQNKSKKKAQQAAADTGNSSQVSQNYPIVQNIQGQMVHQAISPRTLNAWVKVIEEKAFSPEVIPMFSALSEGATPQDLNTMLNTVGGHQAAMQMLKETINEEAADWDRLHPVHAGPIAPGQMREPRGSDIAGTTSTLQEQIGWMTNNPPIPVGEIYKRWIIMGLNKIVRMYSPSSILDIKQGPKEPFRDYVDRFYKVLRAEQASQEVKNWMTETLLVQNSNPDCKTILKALGPGATLEEMMTACQGVGGPGHKARVLAEAMSQMTNSATIMMQKGNFRNQRKPVKCFNCGKEGHIAKNCRAPRKKGCWKCGREGHQMKDCTERQANFLGKIWPSYKGRPGNFLQNRPEPTAPPAESFRFGEETTTPSQKQETIDKELYPLASLRSLFGSDPSSQ

SEQ ID NO: 45 - protein, 500 aa, Human immunodeficiency virus 1
MGARASVLSGGQLDRWEKIRLRPGGKKKYRLKHLVWASRELERFAVNPGLLETAEGCRQILEQLQPSLQTGSEELRSLFNTVAVLYCVHQRIEVKDTKEALDKVEEEQNKSKKKAQQTAADTGNNSQVSQNYPIVQNMQGQMVHQALSPRTLNAWVKVIEEKAFSPEVIPMFTALSEGATPQDLNTMLNTVGGHQAAMQMLKDTINEEAAEWDRLHPVQAGPVAPGQIREPRGSDIAGSTSTLQEQIGWMTSNPPIPVGEIYKRWIILGLNKIVRMYSPVSILDIRQGPKEPFRDYVDRFYKTLRAEQATQEVKNWMTETLLVQNANPDCKTILKALGPGATLEEMMTACQGVGGPSHKARVLAEAMSQVTNSATIMMQRGNFRNQRKIVKCFNCGKEGHIARNCRAPRKRGCWKCGKEGHQMKDCNERQANFLGKIWPSHKGRPGNFLQSRPEPSAPPEESFRFGEEKTTPSQKQEPIDKDLYPLASLKSLFGNDPSLQ

SEQ ID NO: 46 - protein, 500 aa, Human immunodeficiency virus 1
MGARASVLSGGELDKWEKIRLRPGGKKKYKLKHIVWASRELERFAVNPGLLETSEGCRQILGQLQPSLQTGSEELRSLYNTVATLYCVHQKIEVKDTKEALEKIEEEQNKCKKKAQQAAAGTGNSSQVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPVAPGQMRDPRGSDIAGTTSNLQEQIGWMTHNPPIPVGDIYKRWIILGLNKIVRMYSPTSILDIRQGPKESFRDYVDRFYKTLRAEQASQDVKNWMTETLLVQNANPDCRTILKALGPAATLEEMMTACQGVGGPSHKARILAEAMSQVTNPATIMMQRGNFRNQRKTVKCFNCGKEGHLARNCRAPRKKGCWKCGKEGHQMKECTERQANFLGKIWPSHKGRPGNFLQSRPEPTAPPEESFRFGEETATPPQKQEPIDKELYPLTSLRSLFGNDPSSQ

SEQ ID NO: 47 - protein, 500 aa, Human immunodeficiency virus 1
MGARASVLSGGQLDRWEKIRLRPGGKKKYRLKHLVWASRELERFAVNPGLLETAEGCRQILEQLQPSLQTGSEELRSLFNTVATLYCVHQRIDVKDTKEALDKIEEEQNKCKKKAQQAAADTGNSSQVSQNYPIVQNIQGQMVHQALSPRTLNAWVKVVEEKAFSPEVIPMFTALSEGATPQDLNTMLNTVGGHQAAMQMLKETINEEAAEWDRLHPVQAGPVAPGQMREPRGSDIAGSTSTLQEQIGWMTNNPPIPVGDIYKRWIILGLNKIVRMYSPVSILDIRQGPKESFRDYVDRFYKVLRAEQASQEVKNWMTETLLVQNANPDCRTILKALGPAATLEEMMTACQGVGGPGHKARVLAEAMSQMTNSATIMMQRGNFRNQRKTVKCFNCGKEGHIAKNCRAPRKKGCWKCGKEGHQMKECTERQANFLGKIWPSYKGRPGNFLQSRPEPSAPPAESFRFGEETTTPSQKQETIDKELYPLTSLRSLFGNDPSLQ

SEQ ID NO: 48 - protein, 500 aa, Human immunodeficiency virus 1
MGARASVLSGGELDKWEKIRLRPGGKKKYKLKHIVWASRELERFAINPGLLETSEGCRQILGQLQPALQTGSEELRSLYNTVATLYCVHQKIEVKDTKEALEKVEEEQNKSKQKAQQAAADTGNNSQVSQNYPIVQNLQGQMVHQAISPRTLNAWVKVIEEKAFSPEVIPMFAALSEGATPQDLNTMLNTVGGHQAAMQMLKETINEEAADWDRLHPVHAGPIAPGQIREPRGSDIAGTTSNLQEQIAWMTNNPPIPVGEIYKRWIIMGLNKIVRMYSPTSILDIKQGPKEPFRDYVDRFYRTLRAEQASQDVKNWMTETLLVQNANPDCRTILKALGPGATLEEMMTACQGVGGPSHKARVLAEAMSQVTNPATIMMQRGNFRNQRKPVKCFNCGKEGHLAKNCRAPRKRGCWKCGKEGHQMKDCNERQANFLGKIWPSHKGRPGNFLQNRPEPSAPPEESFRFGEETATPSQKQEPIDKELYPLASLRSLFGSDPSSQ

SEQ ID NO: 49 - protein, 500 aa, Human immunodeficiency virus 1
MGARASILSGGELDRWEKIRLRPGGKKQYRLKHIVWASRELERFAVNPGLLETSEGCKQILEQLQPALQTGSEELKSLYNTVAVLYCVHQRIEIKDTKEALEKIEEEQNKSKKKAQQTAADTGNNSQVSQNYPIVQNLQGQMVHQPISPRTLNAWVKVIEEKAFSPEVIPMFSALAEGATPQDLNTMLNTVGGHQAAMQMLKETINEEAAEWDRLHPVHAGPVAPGQMRDPRGSDIAGTTSNLQEQIGWMTSNPPIPVGEIYKRWIILGLNKIVRMYSPTSILDIRQGPKEPFRDYVDRFYKTLRAEQATQEVKNWMTETLLVQNANPDCKTILKALGPGATLEEMMTACQGVGGPSHKARILAEAMSQVTNSATVMMQRGNFRNQRKTIKCFNCGKEGHLARNCRAPRKKGCWKCGREGHQMKDCTERQANFLGKIWPSYKGRPGNFLQNRPEPTAPPAESFRFGEETTTPPQKQEPIDKELYPLASLKSLFGNDPSSQ

SEQ ID NO: 50 - protein, 500 aa, Human immunodeficiency virus 1
MGARASVLSGGKLDKWEKIRLRPGGKKKYQLKHIVWASRELERFALNPGLLETSDGCRQILGQLQPSLQTGSEELKSLFNTVAVLYCVHQRIEVKDTKEALDKVEEEQNKSKKKAQQAAAGTGNSSQVSQNYPIVQNMQGQMVHQALSPRTLNAWVKVIEEKAFSPEVIPMFSALSEGATPQDLNTMLNTVGGHQAAMQMLKDTINEEAAEWDRVHPVHAGPIAPGQMREPRGSDIAGTTSTLQEQIGWMTHNPPIPVGEIYKRWIILGLNKIVRMYSPSSILDIRQGPKEPFRDYVDRFYKTLRAEQASQEVKNWMTETLLVQNSNPDCKTILKALGPAATLEEMMTACQGVGGPSHKARVLAEAMSQVTNSATIMMQKGNFRNQRKIVKCFNCGKEGHIARNCRAPRKKGCWRCGKEGHQMKDCTERQVNFLGKIWPSYKGRPGNFLQSRPEPTAPPEESFRFGEEKTTPSQKQEPIDKDLYPLASLKSLFGNDPLSQ

SEQ ID NO: 51 - protein, 500 aa, Human immunodeficiency virus 1
MGARASILSGGELDRWEKIRLRPGGSKKYRLKHIVWASRELERFAVNPGLLETAEGCRQILGQLQPSLQTGSEELRSLYNTIATLYCVHQRIEIKDTKEALEKIEEEQNKSKKKAQQTAADTGNNSQVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPVAPGQIREPRGSDIAGTTSNLQEQIGWMTSNPPIPVGEIYKRWIILGLNKIVRMYSPISILDIRQGPKEPFRDYVDRFYRTLRAEQASQDVKNWMTETLLVQNANPDCKTILKALGPGATLEEMMTACQGVGGPGHKARVLAEAMSQVTNSATVMMQRGNFRNQRRTVKCFNCGKEGHIARNCRAPRKKGCWKCGQEGHQMKDCTERQANFLGKIWPSYKGRPGNFLQSRPEPTAPPAESFRFGEETTTPPQKQEPIDKELYPLTSLKSLFGNDPSSQ

SEQ ID NO: 52 - protein, 500 aa, Human immunodeficiency virus 1
MGARASVLSGGKLDRWEKIRLRPGGKKKYRLKHVVWASRELERFAVNPGLLESSEGCRQILEQLQPSLQTGSEELRSLFNTVATLYCVHQRIDVKDTKEALDKIEEEQNKCKKKAQQAAADTGNNSQVSQNYPIVQNLQGQMVHQPISPRTLNAWVKVVEEKAFSPEVIPMFAALSEGATPQDLNTMLNTVGGHQAAMQMLKETINEEAAEWDRVHPVHAGPIAPGQMREPRGSDIAGSTSTLQEQIGWMTNNPPIPVGDIYKRWIILGLNKIVRMYSPASILDIRQGPKEPFRDYVDRFYKTLRAEQATQEVKNWMTETLLVQNANPDCRTILKALGPGATLEEMMTACQGVGGPGHKARVLAEAMSQMTNSATIMMQKGNFRNQRKTIKCFNCGKEGHIARNCKAPRKKGCWKCGREGHQMKDCIERQANFLGKIWPSHKGRPGNFLQNRPEPTAPPEESFRFGEETATPPQKQEPIDKELYPLASLKSLFGSDPSSQ

SEQ ID NO: 53 - protein, 500 aa, Human immunodeficiency virus 1
MGARASVLSGGELDRWEKIRLRPGGKKKYRLKHLVWASRELERFAVNPGLLETSDGCRQILGQLQPALQTGSEELKSLYNTVATLYCVHQKIDVRDTKEALDKIEEEQNKSKQKAQQAAADTGNSSQVSQNYPIVQNIQGQMVHQAISPRTLNAWVKVVEEKAFSPEVIPMFTALSEGATPQDLNTMLNTVGGHQAAMQMLKETINEEAAEWDRLHPVQAGPVAPGQMREPRGSDIAGTTSTLQEQIGWMTHNPPIPVGEIYKRWIIMGLNKIVRMYSPSSILDIRQGPKESFRDYVDRFYKVLRAEQASQEVKNWMTETLLVQNANPDCKTILKALGPGATLEEMMTACQGVGGPSHKARVLAEAMSQVTNSATIMMQRGNFRNQRKTVKCFNCGKEGHIAKNCRAPRKRGCWKCGKEGHQMKECTERQANFLGKIWPSHKGRPGNFLQSRPEPTAPPEESFRFGEEKTTPSQKQETIDKELYPLASLRSLFGNDPSSQ

SEQ ID NO: 54 - protein, 500 aa, Human immunodeficiency virus 1
MGARASVLSGGELDKWEKIRLRPGGKKKYQLKHIVWASRELERFAVNPGLLETSEGCKQILEQLQPALQTGSEELRSLYNTIAVLYCVHQKIEIKDTKEALDKVEEEQNKSKKKAQQAAAGTGNSSQVSQNYPIVQNLQGQMVHQPLSPRTLNAWVKVVEEKAFSPEVIPMFTALSEGATPQDLNTMLNTVGGHQAAMQMLKETINEEAADWDRLHPVHAGPIAPGQMREPRGSDIAGSTSTLQEQIGWMTHNPPIPVGDIYKRWIILGLNKIVRMYSPTSILDIKQGPKEPFRDYVDRFYKTLRAEQATQEVKNWMTETLLVQNANPDCRTILKALGPAATLEEMMTACQGVGGPSHKARILAEAMSQVTNPATIMMQRGNFRNQRKPVKCFNCGKEGHIARNCRAPRKRGCWKCGKEGHQMKDCTERQVNFLGKIWPSHKGRPGNFLQNRPEPSAPPAESFRFGEETTTPSQKQEPIDKEMYPLASLRSLFGSDPSSQ

SEQ ID NO: 55 - protein, 500 aa, Human immunodeficiency virus 1
MGARASVLSGGQLDRWEKIRLRPGGKKQYRLKHIVWASRELERFAINPGLLETSEGCRQILGQLQPSLQTGSEELKSLFNTVAVLYCVHQRIEVKDTKEALEKVEEEQNKSKKKAQQAAADTGNSSQVSQNYPIVQNLQGQMVHQALSPRTLNAWVKVIEEKAFSPEVIPMFSALSEGATPQDLNTMLNTVGGHQAAMQMLKDTINEEAAEWDRLHPVHAGPVAPGQMRDPRGSDIAGTTSTLQEQIAWMTNNPPIPVGEIYKRWIILGLNKIVRMYSPTSILDIRQGPKEPFRDYVDRFYKVLRAEQASQDVKNWMTETLLVQNANPDCKTILKALGPAATLEEMMTACQGVGGPGHKARVLAEAMSQVTNSTTIMMQRGNFRNQRKIVKCFNCGKEGHLAKNCRAPRKKGCWKCGKEGHQMKECTERQANFLGKIWPSHKGRPGNFLQSRPEPSAPPEESFRFGEETATPSQKQEPIDKDLYPLASLKSLFGNDPLSQ

SEQ ID NO: 56 - protein, 500 aa, Human immunodeficiency virus 1
MGARASVLSGGKLDKWEKIRLRPGGKKKYKLKHIVWASRELERFALNPGLLETSEGCRQILRQLQPSLQTGSEELRSLYNTVATLYCVHQKIEVKDTKEALEKIEEEQNKSKKKAQQTAADTGNNSQVSQNYPIVQNMQGQMVHQALSPRTLNAWVKVVEEKAFSPEVIPMFSALSEGATPQDLNTMLNTVGGHQAAMQMLKDTINEEAAEWDRLHPAQAGPIAPGQIREPRGSDIAGTTSNLQEQIAWMTHNPPIPVGDIYKRWIILGLNKIVRMYSPVSILDIRQGPKEPFRDYVDRFYKTLRAEQASQEVKNWMTETLLVQNSNPDCKTILKALGPGATLEEMMTACQGVGGPGHKARVLAEAMSQVTNPATIMMQKGNFKNQRKTVKCFNCGKEGHLARNCRAPRKKGCWRCGKEGHQMKDCNERQANFLGKIWPSHKGRPGNFLQSRPEPTAPPEESFRFGEETTTPAQKQEPIDKELYPLTSLRSLFGNDPSLQ

SEQ ID NO: 57 - protein, 499 aa, Human immunodeficiency virus 1
MGARASILRGGKLDKWEKIRLRPGGKKHYMLKHLVWASRELERFALNPGLLETSEGCKQIIKQLQPALQTGTEELRSLYNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPSHKARVLAEAMSQANNTNIMMQRSNFKGSKRIVKCFNCGKEGHIARNCRAPRKKGCWKCGKEGHQMKDCTERQANFLGKIWPSHKGRPGNFLQSRPEPTAPPAEPTAPPAESFRFEETTPAPKQEPKDREPLTSLKSLFGSDPLSQ

SEQ ID NO: 58 - protein, 506 aa, Human immunodeficiency virus 1
MGARASVLRGEKLDKWERIRLRPGGKKHYMLKHLVWASRELERFALNPSLLETSEGCKQIIQQLQPALKTGTEELRSLFNTVATLYCVHAGIEVRDTKEALDKIEEEQNKCQQKTQQAKEADGKVSQNYPIVQNLQGQMVHQALSPRTLNAWVKVIEEKAFSPEVIPMFTALSEGATPSDLNTMLNTVGGHQAAMQMLKDTINEEAAEWDRLHPVQAGPVAPGQMREPRGSDIAGTTSNLQEQIAWMTGNPPVPVGDIYKRWIILGLNKIVRMYSPVSILDIRQGPKEPFRDYVDRFFKTLRAEQSTQEVKNWMTETLLVQNANPDCKTILRALGPAASLEEMMTACQGVGGPSHKARVLAEAMSQANSTNIMMQRGNFKGPKRIIKCFNCGKEGHLARNCRAPRKKGCWKCGKEGHQMKDCIERQANFLGKIWPSNKGRPGNFLQNRPEPTAPPVEPTAPPAEPTAPPAESFKFEETTPAPKQEPKDREPLTSLRSLFGSDPLSQ

SEQ ID NO: 59 - protein, 492 aa, Human immunodeficiency virus 1
MGARASILRGEKLDTWEKIRLRPGGRKHYMLKHIVWASRELEKFALNPGLLETSEGCKQIMKQLQPALQTGTEELKSLYNTVATLYCVHEKIEVRDTKEAVDKIEEEQNKSQQKTQQAKAADEKVSQNYPIVQNIQGQMVHQPISPRTLNAWVKVIEEKGFNPEVIPMFTALSEGATPQDLNTMLNTVGGHQAAMQMLKDTINDEAAEWDRLHPVHAGPIAPGQMREPRGSDIAGSTSTLQEQITWMTSNPPVPVGEIYKRWIILGLNKIVRMYSPVSILDIKQGPKEPFRDYVDRFFKVLRAEQATQDVKNWMTDTLLIQNANPDCKTILKALGPGASLEEMMTACQGVGGPGHKARVLAEAMSQANNTNIMMQRSNFKGPKRIVKCFNCGKEGHIAKNCRAPRKKGCWKCGQEGHQMKDCTERQANFLGKIWPSQKGRPGNFLQNRPEPSAPPAESFRFGETTPAPKQELKDREPLTSLKSLFGSDPLSQ

SEQ ID NO: 60 - protein, 491 aa, Human immunodeficiency virus 1
MGARASILRGGKLDKWEKIRLRPGGKKRYMLKHLIWASRELERFALNPGLLETAEGCKQIIKQLQPALQTGTEELRSLYNTVATLYCVHKRIDVRDTKEALDKIEEEQNKIQQKTQQAKAADGKVSQNYPIVQNAQGQMVHQAISPRTLNAWVKVVEEKAFSPEIIPMFTALSEGATPQDLNSMLNAVGGHQAAMQMLKDTINEEAAEWDRVHPVHAGPVAPGQIREPRGSDIAGTTSTLQEQIAWMTSNPPIPVGDIYKRWIIMGLNKIVRMYSPVSILDIKQGPKESFRDYVDRFFKTLRAEQATQEVKNWMTDTLLVQNANPDCKTILRALGPGATLEEMMTACQGVGGPSHKARVLAEAMSQTNSAILMQRSNFKGSKRIVKCFNCGKEGHIARNCRAPRKRGCWKCGKEGHQMKECTERQANFLGKIWPSHKGRPGNFLQSRPEPTAPPAESFRFEETTPAPKQESKDREPLISLKSLFGNDPLSQ

SEQ ID NO: 61 - protein, 497 aa, Human immunodeficiency virus 1
MGARASVLRGEKLDTWERIKLRPGGKKHYMIKHLVWASRELEKFALNPGLLETSEGCKQIIQQLQPALKTGTEELKSLYNTVATLYCVHERIDVRDTKEALDKIEEEQNKIQQKTQQAKEADGKVSQNYPIVQNAQGQMVHQALSPRTLNAWVKVVEEKAFSPEIIPMFTALSEGATPSDLNTMLNTIGGHQAAMQMLKDTINDEAAEWDRLHPVHAGPIAPGQIREPRGSDIAGTTSTLQEQITWMTSNPPVPVGEIYKRWIILGLNKIVRMYSPVSILDIKQGPKESFRDYVDRFFKTLRAEQSTQEVKNWMTETLLVQNANPDCKTILKALGPGATLEEMMTACQGVGGPGHKARVLAEAMSQTNSAILMQRSNFKGSKRIVKCFNCGREGHIARNCKAPRKKGCWKCGKEGHQMKDCIERQANFLGKIWPSHKGRPGNFLQNRPEPTAPPEPTAPPAESFRFGETTPAPKQEQKDREPLISLKSLFGSDPLLQ

SEQ ID NO: 62 - protein, 492 aa, Human immunodeficiency virus 1
MGARASILRGEKLDKWERIRLRPGGKKHYMLKHLVWASRELDRFALNPGLLETSDGCKQIIKQLHPALQTGTEELRSLFNTVATLYCVHAGIEVRDTKEAVDKIEEEQNKSQQKTQQAKAADEKVSQNYPIVQNIQGQMVHQPISPRTLNAWVKVIEEKAFSPEVIPMFTALSDGATPQDLNTMLNTVGGHQAAMQMLKDTINEEAAEWDRIHPVHAGPVAPGQMRDPRGSDIAGSTSTLQEQIAWMTNNPPVPVGDIYKRWIIMGLNKIVRMYSPVSILDIRQGPKEPFRDYVDRFFRTLRAEQATQDVKNWMTDTLLIQNANPDCKTILRALGPGASLEEMMTACQGVGGPGHKARVLAEAMSQANNTNIMMQKSNFKGPKRTVKCFNCGKEGHIARNCRAPRKRGCWKCGKEGHQMKECTERQANFLGKIWPSQKGRPGNFLQSRPEPSAPPAESFRFEETTPAPKQESKDREPLTSLKSLFGSDPSSQ

SEQ ID NO: 63 - protein, 492 aa, Human immunodeficiency virus 1
MGARASILRGGKLDTWEKIRLRPGGKKRYMLKHLIWASRELERFALNPSLLETSEGCKQIMKQLQPALQTGTEELRSLYNTVATLYCVHKGIKVQDTKEALDKIEEEQKKSQQKTQQAEAADKGKVSQNYPIVQNLQGQMVHQPLSPRTLNAWVKVIERKAFSPEVIPMFSALSEGATPQDLNSMLNAVGGHQAAMQMLKDTINEEAAEWDRVHPVHAGPIAPGQMREPRGSDIAGTTSNLQEQIAWMTSNPPIPVGDIYKRWIVLGLNKIVRMYSPVSILDIKQGPKEPFRDYVDRFFKTLRAEQATQEVKNWMTDTLLVQNANPDCKTILRALGPAASLEEMMTACQGVGGPGHKARVLAEAMSQANSNIMMQRGNFKGPKRIIKCFNCGKEGHLARNCRAPRKKGCWKCGREGHQMKDCTERQANFLGKIWPSNKGRPGNFLQSRPEPTAPPAESFGFGETTPAPKQELKDREPLTSLKSLFGNDPLSQ

SEQ ID NO: 64 - protein, 505 aa, Human immunodeficiency virus 1
MGARASILRGGKLDKWEKIRLRPGGRKHYMLKHIVWASRELERFALNPGLLETAEGCKQIIKQLQPALQTGTEELKSLFNTVATLYCVHEKIEVRDTKEALDKIEEEQNKCQQKTQQAKAADGKVSQNYPIVQNLQGQMVHQAISPRTLNAWVKVIEEKGFNPEVIPMFTALSEGAAPQDLNTMLNTIGGHQAAMQMLKDTINEEAAEWDRLHPVQAGPVAPGQMREPRGSDIAGTTSSLQEQIAWMTGNPPVPVGDIYKRWIILGLNKIVRMYSPVSILDIRQGPKEPFRDYVDRFFKVLRAEQATQDVKNWMTETLLVQNANPDCKTILRALGPGATLEEMMTACQGVGGPSHKARVLAEAMSQANNANIMMQRSNFKGPKRIVKCFNCGKEGHIAKNCRAPRKKGCWKCGQEGHQMKDCNERQANFLGRIWPSHKGRPGNFIQSRPEPTAPLEPTAPPAEPTAPPAESFKFEETTPAPKQEPKDREPLTSLRSLFGSDPLSQ

SEQ ID NO: 65 - protein, 491 aa, Human immunodeficiency virus 1
MGARASVLRGEKLDTWERIKLRPGGKKHYMIKHLVWASRELEKFALNPGLLETAEGCKQIIRQLQPALQTGTEELRSLYNTVATLYCVHKRIDVRDTKEALDKIEEEQNKSQQKAQQAKAADGKVSQNYPIVQNLQGQMVHQSLSPRTLNAWVKVIERKAFSPEVIPMFSALSEGATPQDLNTMLNTVGGHQAAMQMLKDTINEEAAEWDRIHPVHAGPIAPGQMREPRGSDIAGTTSTLQEQITWMTSNPPVPVGEIYKRWIILGLNKIVRMYSPVSILDIRQGPKEPFRDYVDRFFKTLRAEQSTQEVKNWMTDTLLAQNANPDCKIILRGLGPGATLEEMMTACQGVGGPGHKARVLAEAMSQANSNILMQRSNFKGPRRTIKCFNCGKEGHLAKNCRAPRKKGCWKCGKEGHQMKECTERQANFLGKIWPSQKGRPGNFLQSRPEPSAPPAESFRFEETTPALKQEPKDREPLTSLRSLFGSDPLSQ

SEQ ID NO: 66 - protein, 499 aa, Human immunodeficiency virus 1
MGASASILRGEKLDRWEKIRLRPGGKKCYMLKHIIWASKELERFALNPGLLETSEGCKQIMKQLQPALQTGTEELKSLYNTVATLYCVHEKIEVRDTKEALDKIEEEQKKSQQKTQQAEAADKGKVSQNYPIVQNAQGQMVHQALSPRTLNAWVKVVEEKAFSPEIIPMFTALSEGAAPQDLNTMLNTVGGHQAAMQMLKDTINEEAAEWDRVHPVHAGPIAPGQIREPRGSDIAGTTSTLQEQVAWMTSNPPVPVGDIYKRWIVLGLNKIVRMYSPVSILDIKQGPKEPFRDYVDRFFKTLRAEQSSQEVKNWMTDTLLVQNANPDCKTILRALGPAASLEEMMTACQGVGGPSHKARVLAEAMSQANSTNIMMQRGNFKGPKRIVKCFNCGREGHIARNCRAPRKKGCWKCGQEGHQMKDCIERQANFLGKIWPSHKGRPGNFIQSRPEPTAPPEPTAPPAESFRFGETTPAPKQESKDREPLTSLKSLFGNDPLSQ

SEQ ID NO: 67 - protein, 499 aa, Human immunodeficiency virus 1
MGARASVLKGEKLDKWERIRLRPGGKKQYRLKHLVWASRELERFALNPSLLETSEGCRQIIKQLQPALKTGTEELRSLYNTIATLYCVHKGIKVQDTKEALDKVEEEQNKSQQKTQQAKAADEKVSQNYPIVQNLQGQMVHQPLSPRTLNAWVKVIEEKGFNPEVIPMFTALSEGATPQDLNSMLNAVGGHQAAMQMLKDTINEEAAEWDRLHPVQAGPVAPGQIREPRGSDIAGTTSSLQEQIAWMTGNPPVPVGDIYKRWIILGLNKIVRMYSPVSILDIKQGPKESFRDYVDRFFKTLRAEQATQDVKNWMTETLLVQNANPDCKTILRALGPGATLEEMMTACQGVGGPSHKARVLAEAMSQANNANIMMQRSNFKGPKRTVKCFNCGKEGHIAKNCRAPRKKGCWKCGREGHQMKDCIERQANFLGKIWPSNKGRPGNFLQNRTEPTAPPAEPTAPPAESFRFEETTPAPKQELKDREPLTSLKSLFGSDPLLQ

SEQ ID NO: 68 - protein, 492 aa, Human immunodeficiency virus 1
MGARASILRGEKLDKWEKIRLRPGGRKHYMLKHIVWASRELEGFALNPGLLETSEGCKQIIKQLQPALQTGTEELRSLFNTVATLYCVHSGIEVRDTKEAVDKIEEEQNKIQQKTQQAKEADGKVSQNYPIVQNSQGQMVHQAISPRTLNAWVKVIEEKAFSPEVIPMFTALSEGATPSDLNTMLNTIGGHQAAMQMLKDTINDEAAEWDRLHPVHAGPIAPGQMRDPRGSDIAGSTSTLQEQIAWMTNNPPVPVGDIYKRWIIMGLNKIVRMYSPVSILDIKQGPKEPFRDYVDRFFRTLRAEQATQEVKNWMTETLLVQNANPDCRTILKALGPGATLEEMMTACQGVGGPGHKARVLAEAMSQANNINIMMQRNNFKGPKRIIKCFNCGKEGHIARNCKAPRKKGCWKCGKEGHQMKDCNERQANFLGKIWPSHKGRPGNFLQNRPEPTAPPAESFRFEETTPTPKQEPKDREPLTSLKSLFGSDPSSQ

SEQ ID NO: 69 - protein, 498 aa, Human immunodeficiency virus 1
MGARASILRGGKLDKWEKIRLRPGGKKRYMLKHLIWASRELERFALNPGLLETSDGCKQIIQQLQPALKTGTEELKSLFNTVAVLYCVHKGIEVRDTKEAVDKIEEEQNKIQQKMQQQKVTDGKVSQNYPIVQNIQGQMVHQPISPRTLNAWVKVIEEKGFSPEVIPMFTALSEGATPSDLNTMLNTVGGHQAAMQMLKDTINEEAAEWDRTHPVHAGPVAPGQMREPRGSDIAGTTSTLQEQIGWMTNNPPIPVGEIYKRWIILGLNKIVRMYSPVSILDIKQGPKEPFRDYVDRFFKALRAEQATQEVKGWMTDTLLVQNANPDCKTILKALGSGATLEEMMTACQGVGGPGHKARVLAEAMSQANNTNIMMQKSNFKGPRRIVKCFNCGREGHIAKNCRAPRKKGCWKCGQEGHQMKDCTERQANFLGRIWPSHKGRPGNFLQSRPEPTAPLQPTAPPAESFKFEETTPAPKQEQKDREPLTSLRSLFGNDPLSQ

SEQ ID NO: 70 - protein, 499 aa, Human immunodeficiency virus 1
MGARASILRGGKLDTWEKIRLRPGGKKHYMLKHLVWASRELDRFALNPGLLETADGCKQIIKQLHPALQTGTEEIKSLFNTVATLYCVHAGIEVRDTKEALDKIEEEQNKCQQKTQQAKEADKKVSQNYPIVQNLQGQMVHQAISPRTLNAWVKVIEEKAFNPEIIPMFTALSDGATPQDLNTMLNTVGGHQAAMQMLKDTINEEAADWDRLHPVHAGPVAPGQLREPRGSDIAGTTSNLQEQIAWMTSNPPIPVGDIYKRWIILGLNKIVRMYSPVSILDIKQGPKEPFRDYVDRFFKVLRAEQATQDVKNWMTDTLLIQNANPDCKTILRALGPGASLEEMMTACQGVGGPSHKARVLAEAMSQTNSAILMQRSNFKGSKRIVKCFNCGKEGHLARNCRAPRKRGCWKCGKEGHQMKDCTTERQANFLGKIWPSHKGGRPGNFLQNRPEPTAPLEPTAPPAESFGFGETTPAPKQEPKDREPLISLKSLFGSDPLSQ

SEQ ID NO: 71 - protein, 499 aa, Human immunodeficiency virus 1
MGARASILRGGKLDKWEKIRLRPGGKKHYMLKHLVWASRELERFALNPGLLETSEGCKQIIKQLQPALQTGTEELRSLFNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGEIYKRWIILGLNKIVRMYSPVSILDIRQGPKEPFRDYVDRFFKTLRAEQATQDVKNWMTDTLLVQNANPDCKTILRALGPGATLEEMMTACQGVGGPSHKARVLAEAMSQANNTNIMMQRSNFKGSKRIVKCFNCGKEGHIARNCRAPRKKGCWKCGKEGHQMKDCTERQANFLGKIWPSHKGRPGNFLQSRPEPTAPPAEPTAPPAESFRFEETTPAPKQEPKDREPLTSLKSLFGSDPLSQ

SEQ ID NO: 72 - protein, 497 aa, Human immunodeficiency virus 1
RASVLSGGKLDAWEKIRLRPGGKKKYKLKHIVWASRELERFAVNPGLLETSEGCRQILGQLQPSLQTGSEELRSLYNTVAVLYCVHQRIEVKDTKEALEKIEEEQNKSKKKAQQAAADTGNSSQVSQNYPIVQNLQGQMVHQAISPRTLNAWVKVIEEKAFSPEVIPMFTALSEGATPSDLNTMLNTIGGHQAAMQILKDTINEEAAEWDRLHPVHAGPIAPGQMREPRGSDIAGTTSTLQEQIGWMTNNPPIPVGEIYKRWIILGLDKIVRMYSPTSILDIRQGPKESFRDYVDRFYKTLRAEQASQEVKNWMTETLLVQNANPDCKTILKALGPAATLEEMMTACQGVGGPSHKARILAEAMSQVTNSATIMMQRGNFRNQRKTVKCFNCGKEGHIAKNCRAPRKKGCWKCGKEGHQMKDCNERQANFLGKIWPSHKGRPGNFLQSRPEPTAPPEESFRFGEETTTPSQKQEPIDKELYPLASLKSLFGNDPLSQ

SEQ ID NO: 73 - protein, 494 aa, Human immunodeficiency virus 1
MGARASILRGGKLDKWEKIRLRPGGKKHYMLKHLVWASRELERFALNPGLLETAEGCKQIIKQLQPALKTGTEELKSLYNTVATLYCVHEKIEVRDTKEALDKLEEEQNKSQQKTQQAAAGTGSSSKVSQNYPIVQNAQGQMVHQALSPRTLNAWVKVVEEKAFSPEVIPMFSALAEGATPQDLNTMLNTVGGHQAAMQMLKDTINEEAADWDRLHPVHAGPVAPGQMREPRGSDIAGSTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGASLEEMMTACQGVGGPGHKARVLAEAMSQANNANIMMQRGNFKGQKRIKCFNCGKEGHLARNCRAPRKKGCWKCGREGHQMKDCTERQANFLGRIWPSSKGRPGNFPQSRPEPSAPPAESFGFGETTPAPKQELKDREPLTSLKSLFGSDPLSQ

SEQ ID NO: 74 - protein, 498 aa, Human immunodeficiency virus 1
MGARASVLSGGELDRWEKIRLRPGGKKKYRLKHLVWASRELEKFALNPGLLETSEGCKQIMKQLQPALQTGTEELRSLFNTVATLYCVHQRIDVKDTKEALDKIEEEQNKIQQKTQQAKAADGKVSQNYPIVQNIQGQMVHQPISPRTLNAWVKVVEEKGFNPEVIPMFSALSEGATPQDLNMMLNIVGGHQAAMQMLKETINEEAAEWDRVHPVHAGPIPPGQMREPRGSDIAGTTSNLQEQIGWMTSNPPVPVGDIYKRWIVLGLNKIVRMYSPVSILDIRQGPKEPFRDYVDRFFKVLRAEQATQEVKNWMTDTLLIQNANPDCKSILRALGPGATLEEMMTACQGVGGPSHKARVLAEAMSQTNSAILMQRSNFKGSKRIVKCFNCGKEGHIARNCRAPRKRGCWKCGQEGHQMKDCTERQVNFLGKIWPSNKGRPGNFLQNRPEPTAPPAEPTAPPAESFRFEETTPAPKQEPKDREPLTSLRSLFGNDPSSQ

SEQ ID NO: 75 - protein, 494 aa, Human immunodeficiency virus 1
MGARASVLSGGELDRWEKIRLRPGGKKKYKLKHIVWASRELERFAVNPGLLETSEGCRQILGQLQPSLQTGSEELRSLYNTVAVLYCVHQRIDVKDTKEALEKIEEEQNKSQQKTQQAKAADGKVSQNYPIVQNAQGQMVHQAISPRTLNAWVKVIEEKGFSPEVIPMFSALAEGATPQDLNTMLNTIGGHQAAMQMLKDTINDEAAEWDRLHPVQAGPVAPGQIREPRGSDIAGTTSNLQEQIGWMTSNPPIPVGDIYKRWIIMGLNKIVRMYSPTSILDIRQGPKESFRDYVDRFFRTLRAEQASQEVKNWMTETLLVQNSNPDCKTILKALGPAATLEEMMTACQGVGGPGHKARVLAEAMSQVQQPNIMMQRGNFKGQKRIKCFNCGREGHLARNCRAPRKKGCWKCGREGHQMKDCTESKANFLGKIWPSNKGRPGNFLQSRPEPSAPPAESFGFGEEITPSQKQEQKDKELYPLASLKSLFGNDPLSQ

SEQ ID NO: 76 - protein, 497 aa, Human immunodeficiency virus 1
MGARASVLSGGKLDAWEKIRLRPGGKKKYRLKHLVWASRELDRFALNPSLLETAEGCKQIMKQLQPALKTGTEELKSLYNTVATLYCVHEKIDVRDTKEALDKIEEEQNKIQQKTQQAKEADGKVSQNYPIVQNIQGQMVHQPISPRTLNAWVKVVEEKAFSPEVIPMFTALSDGATPQDLNSMLNAVGGHQAAMQILKDTINEEAADWDRLHPVHAGPVAPGQMREPRGSDIAGTTSTLQEQIGWMTNNPPIPVGEIYKRWIILGLNKIVRMYSPVSILDIKQGPKESFRDYVDRFFKVLRAEQATQDVKNWMTDTLLIQNANPDCKSILRALGPGATLEEMMTACQGVGGPSHKARILAEAMSQVTNSATIMMQRGNFRNQRKTVKCFNCGKEGHLARNCKAPRKRGCWKCGKEGHQMKECTERQANFLGKIWPSSKGRPGNFPQSRPEPTAPPEESFRFGEETTTPSQKQEPIDKELYPLASLRSLFGNDPSSQ

SEQ ID NO: 77 - protein, 500 aa, Human immunodeficiency virus 1
MGARASILRGGKLDKWEKIRLRPGGKKRYMLKHLIWASRELERFALNPGLLETAEGCQQIIEQLQSTLKTGSEELKSLFNTVATLYCVHQRIEVKDTKEALDKVEEEQNKSKKKAQQAAADTGNSSQVSQNYPIVQNLQGQMVHQALSPRTLNAWVKVIEEKAFSPEIIPMFTALSEGATPSDLNTMLNTVGGHQAAMQMLKDTINEEAAEWDRVHPVHAGPIPPGQMREPRGSDIAGTTSSLQEQIAWMTSNPPVPVGEIYKRWIVLGLNKIVRMYSPVSILDIRQGPKEPFRDYVDRFFKTLRAEQASQDVKNWMTETLLVQNANPDCKTILRALGPGASLEEMMTACQGVGGPSHKARVLAEAMSQTNSAILMQRSNFKGSKRIVKCFNCGKEGHIARNCRAPRKRGCWKCGQEGHQMKDCNERQANFLGKIWPSHKGRPGNFLQNRPEPTAPPEPTAPPAESFRFEETTPAPKQELKDREPLTSLKSLFGSDPLSQ

SEQ ID NO: 78 - protein, 502 aa, Human immunodeficiency virus 1
MGARASVLRGEKLDKWERIRLRPGGKKHYMLKHLVWASRELEKFALNPGLLETSEGCKQIIKQLQPALQTGTEELRSLFNTVATLYCVHAGIEVRDTKEALDKIEEIQNKSKQKTQQAAAGTGSSSKVSQNYPIVQNLQGQMVHQPLSPRTLNAWVKVVEEKGFNPEVIPMFSALSEGATPQDLNMMLNIVGGHQAAMQMLKETINEEAAEWDRLHPVHAGPIAPGQMREPRGSDIAGSTSTLQEQIAWMTGNPPVPVGDIYKRWIILGLNKIVKMYSPTSILDIKQGPKEPFRDYVDRFYKTLRAEQATQEVKNWMTDTLLVQNANPDCKSILKALGTGATLEEMMSACQGVGGPAHKARVLAEAMSQANNTNIMMQRSNFKGPKRIIKCFNCGKEGHIAKNCRAPRKKGCWKCGKEGHQMKDCTERQANFLGRIWPSSKGRPGNFLQSRPEPTAPPAEPTAPPAESFKFEETTPAPKQEPKDREPLTSLRSLFGSDPLLQ

SEQ ID NO: 79 - protein, 495 aa, Human immunodeficiency virus 1
MGARASILSGGKLDAWEKIRLRPGGRKHYMLKHIVWASRELERFALNPGLLETAEGCQQIIEQLQSTLKTGSEELKSLFNTVATLWCVHQRIEVKDTKEALDKLEEEQNKSQQKTQQAKAADGKVSQNYPIVQNLQGQMVHQSISPRTLNAWVKAIEEKAFSPEVIPMFSALAEGATPQDLNTMLNTIGGHQAAMQILKDTINEEAAEWDRIHPVHAGPVAPGQMRDPRGSDIAGTTSNLQEQIAWMTSNPPVPVGEIYKRWIILGLDKIVRMYSPVSILDIRQGPKEPFRDYVDRFFKTLRAEQATQEVKGWMTDTLLVQNANPDCKTILKALGPGATLEEMMSACQGVGGPGHKARVLAEAMSQANNTNIMMQKSNFKGPKRIIKCFNCGKEGHLARNCRAPRKKGCWKCGQEGHQMKDCTERQANFLGRIWPSHKGRPGNFPQSRLEPTAPPAESFGFGEEIAPSPKQEPKEKELYPLTSLKSLFGNDPLSQ

SEQ ID NO: 80 - protein, 496 aa, Human immunodeficiency virus 1
MGARASILRGGKLDKWEKIRLRPGGKKKYKLKHIVWASRELEKFALNPGLLETSEGCRQILGQLQPSLQTGSEELKSLYNTVATLYCVHQRIDVKDTKEALEKIEEEQNKSQQKTQQAAADKGVSQNYPIVQNLQGQMVHQAISPRTLNAWVKVIEEKAFSPEIIPMFTALSEGATPQDLTTMLNTVGGHQAAMQMLKETINDEAAEWDRLHPVHAGPVAPGQLREPRGSDIAGSTSTLQEQIAWMTGNPPVPVGDIYKRWIVLGLNKIVRMYSPTSILDIRQGPKEPFRDYVDRFYKTLRAEQASQDVKNWMTETLLVQNANPDCRTILKALGPAATLEEMMTACQGVGGPAHKARVLAEAMSQVTNPATIMMQRGNFRNQRKTVKCFNCGKEGHLAKNCRAPRKRGCWKCGKEGHQMKDCNERQANFLGKIWPSNKGRPGNFLQNRTEPTAPPAESFRFGEEKTTPSQKQEPIDKELYPLASLRSLFGNDPSLQ

SEQ ID NO: 81 - protein, 514 aa, Human immunodeficiency virus 1
MGARASVLRGEKLDKWERIRLRPGGKKRYMLKHLIWASRELERFALNPSLLETSEGCKQIIQQLQPALKTGTEELRSLYNTVATLYCVHEKIEVRDTKEAVDKIEEEQNKSKKKAQQAAADTGNSSQVSQNYPIVQNIQGQMVHQALSPRTLNAWVKVVEEKGFNPEVIPMFSALSEGATPQDLNMMLNIVGGHQAAMQMLKDTINEEAAEWDRLHPVQAGPVAPGQMREPRGSDIAGTTSTLQEQITWMTSNPPIPVGEIYKRWIIMGLNKIVRMYSPVSILDIKQGPKESFRDYVDRFFRTLRAEQASQEVKNWMTETLLIQNANPDCKTILRALGPAASLEEMMTACQGVGGPGHKARVLAEAMSQTNSAILMQRSNFKGSKRIVKCFNCGKEGHIARNCRAPRKKGCWRCGKEGHQMKDCTESKANFLGKIWPSHKGRPGNFLQNRPEPTAPPEPTAPPAEPTAPPAEPTAPPAESFKFEETTPAPKQELKDREPLISLKSLFGSDPLLQ

SEQ ID NO: 82 - protein, 491 aa, Human immunodeficiency virus 1
MGARASILRGEKLDTWEKIRLRPGGKKQYRLKHIVWASRELDRFALNPSLLETAEGCKQIIKQLHPALQTGTEELRSLFNTVATLYCVHAGIEVRDTKEALDKIEEEQNKIQQKTQQAKAADEKVSQNYPIVQNMQGQMVHQPLSPRTLNAWVKVVEEKAFSPEVIPMFAALSEGATPSDLNTMLNTVGGHQAAMQMLKDTINDEAAEWDRLHPAQAGPIPPGQIREPRGSDIAGTTSTPQEQIGWMTNNPPIPVGEIYKRWIVLGLNKIVRMYSPISILDIRQGPKEPFRDYVDRFFKALRAEQATQEVKGWMTETLLVQNSNPDCKTILRALGPGASLEEMMTACQGVGGPSHKARILAEAMSQANSNIMMQRSNFKGPKRIVKCFNCGKEGHIAKNCRAPRKKGCWKCGREGHQMKDCIERQANFLGKIWPSQKGRPGNFLQSRPEPSAPPAESFRFGETTPAPKQEPKDREPLTSLRSLFGSDPLSQ

SEQ ID NO: 83 - protein, 498 aa, Human immunodeficiency virus 1
MGARASVLSGGELDRWEKIRLRPGGKKKYRLKHLVWASRELERFAINPGLLETSDGCKQIIKQLQPALQTGSEELRSLYNTIATLYCVHQKIEVKDTKEALDKIEEIQNKSKQKTQQAAAGTGSSSKVSQNYPIVQNAQGQMVHQSLSPRTLNAWVKVIEEKGFNPEVIPMFTALSEGATPHDLNTMLNTVGGHQAAMQMLKETINEEAAEWDRVHPVHAGPIPPGQMREPRGSDIAGSTSTLQEQIGWMTSNPPIPVGDIYKRWIILGLNKIVRMYSPSSILDIRQGPKESFRDYVDRFFKCLRAEQATQEVKNWMTDTLLIQNANPDCKSILRALGPGATLEEMMTACQGVGGPGHKARILAEAMSQVQQPNIMMQRGNFKGQKRIKCFNCGREGHIARNCKAPRKKGCWKCGKEGHQMKDCTERQVNFLGKIWPSYKGRPGNFLQSRPEPTAPPEESFRFGEETTTPSQKQETIDKELYPLASLKSLFGNDPSSQ

SEQ ID NO: 84 - protein, 493 aa, Human immunodeficiency virus 1
MGARASVLSGGKLDAWERIRLRPGGKKHYMLKHLVWASRELERFAVNPGLLETSEGCKQIMKQLQPALQTGTEELKSLYNTVAVLYCVHQRIEIKDTKEALDKIEEEQNKCQQKTQQAKEADGKVSQNYPIVQNLQGQMVHQPISPRTLNAWVKVIEEKGFSPEVIPMFTALSDGATPQDLNSMLNAVGGHQAAMQMLKDTINEEAADWDRLHPVHAGPIAPGQMREPRGSDIAGTTSSLQEQIAWMTNNPPVPVGEIYRRWIILGLNKIVKMYSPTSILDIKQGPKEPFRDYVDRFFKVLRAEQATQDVKNWMTDTLLVQNANPDCKSILKALGTGATLEEMMTACQGVGGPSHKARVLAEAMSQVTNSATIMMQKGNFRNQRKIVKCFNCGREGHLARNCKAPRKRGCWKCGKEGHQMKECTERQANFLGKIWPSSKGRPGNFPQSRPEPTAPPAESFRFEETTPAPKQESKDREPLTSLKSLFGSDPSSQ

SEQ ID NO: 85 - protein, 871 aa, Human immunodeficiency virus 1
MRVTGIRKNYQHLWRWGTMLLWRWGTMLLGMLMICSATEKLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDDVRNVTNNATNTNSSWGEPMEKGEIKNCSFNITTSIRDKVQKEYALFYKLDVVPIDNDSNNTNYRLISCNTSVITQACPKVSFEPIPIHYCAPAGFAILKCNDKKFNGTGPCTNVSTVQCTHGIRPVVSTQLLLNGSLAEEEVVIRSENFTNNAKTIMVQLNVSVEINCTRPNNNTRKSIHIGPGRAFYTTGDIIGDIRQAHCNISRAQWNNTLKHIVEKLGKQFGNNKTIVFNHSSGGDPEIVMHSFNCGGEFFYCNSTKLFNSTWTRNNGTWTRNDTERSNSTEEHITLPCRIKQIINMWQEVGKAMYAPPIRGQIRCSSNITGLLLTRDGGNDTSGTEIFRPGGGDMRDNWRSELYKYKVVKIEPLGVAPTKAKRRVVQREKRAVGIGAVFLGFLGAAGSTMGAASMTLTVQARQLLSGIVQQQNNLLRAIEAQQHLLQLTVWGIKQLQARVLAVERYLRDQQLLGIWGCSGKLICTTAVPWNASWSNKSLNEIWNNMTWMEWEKEIDNYTNLIYNLLEESQNQQEKNEQELLELDKWASLWNWFDISNWLWYIKIFIMIVGGLVGLRIVFAVLSIVNRVRQGYSPLSFQTRLPAPRGPDRPEGIEEEGGERDRDRSVRLVDGFLALIWDDLRSLCLFSYHRLRDLLLIVTRIVELLGRRGWEALKYWWNLLQYWSQELKNSAVSLLNATAIAVAEGTDRVIEALQRACRAILHIPRRIRQGLERALL

SEQ ID NO: 86 - protein, 861 aa, Human immunodeficiency virus 1
MRVKETRKNYQHLWKWGTMLLGMLMICSATEKLWVTVYYGVPVWRDANATLFCASDAKAYDTEAHNVWATHACVPTDPNPQEVELKNVTENFNMWKNDMVEQMHEDIINLWDQSLKPCVELTPLCVTLNCTDYVKNITNNATSTNSSWGKPMEKGEIKFCSFNITTSIRNKVQKQYALFYKLDIVPIDNDNTSYRLISCNTSTITQACPKVTFEPIPIHYCAPAGFAILKCNNKTFNGTGPCTNVSTVQCTHGIRPVISTQLLLNGSLAEEEVVIRSENFTNNAKTIMVQLNVSVEINCTRPNNNTRRSIPIGPGRVFYTTEDIIGDIRQAHCNISRAQWNNTLKHIVEKLGKQFGNNKTIVFNHSSGGDPEIVMHSFNCRGEFFYCKSTKLFNSTWTRNNGTWTRNDTERSNSTEEHITLPCRIKQIINMWQEVGKAMYAPPIKGQISCSSNITGLLLTRDGGNDTSGTEIFRPGGGDMRDNWRSELYKYKVVRIEPLGVAPTEAKRRVVQREKRAVGIGAVFLGFLGAAGSTMGAASMTLTVQARLLLSGIVQQQSNLLRAIEAQQHMLQLTVWGIKQLQARLLAVERYLGDQQLLGLWGCSGKLICTTTVPWNTSWSNKSLNEIWDNMTWMQWEREIDNYTGLIYNLLEKSQNQQEKNEQELLELDKWASLWNWFDITNWLWYIKIFIMIVGGLVGLRIVFTVLSIVNRVRKGYSPLSFQTRLPTPRGPDRPGGIEEEGGEQDRDRSGPLVNGFLALIWVDLRSLFLFSYHRLRDLLLIVARIVELLGRRGWEILKYWWNLLLYWSQELKNSAVSLLNATAIAVAEGTDRVIEVVQRAFRAILHIPRRIRQGFERALL

SEQ ID NO: 87 - protein, 871 aa, Human immunodeficiency virus 1
MRVTGIRKNYQHLWRWGTMLLWRWGTMLLGILMICSAAGKLWVTVYYGVPVWKEANTTLFCASDAKAYDTEVHNVWATHACVPIDPNPQEVVLGNVTENFNMWKNNMVEQMHEDIISLWDESLKPCVKLTPICVTLNCTDDVRNVTNNATNTNSSWGEPMEKGEIKNCSFNITTSIRDKVQKQYALFYKLDVVPIDNDSNNTNYRLISCNTSVITQACPKISFEPIPIHFCAPAGFAILKCNDKKFNGTGPCKNVSTVQCTHGIKPVVSTQLLLNGSLAEEEIVIRSENFTDNAKTIIVQLNESVVINCTRPNNNTRKSIHIGPGRAFYATGEIIGDIRQAHCNLSRAKWNDTLKQIVIKLREQFGNKTIVFNQSSGGDPEIVMHSFNCGGEFFYCNTTQLFNSTWTWNNSTWNNTKRSNDTEEIITLPCRIKQIVNMWQKVGKAMYAPPIRGQIRCSSNITGILLTRDGGNNNETNRTETFRPGGGNMKDNWRSELYKYKVVKIEPLGIAPTKARRRVVQREKRAVGTIGAMFLGFLGAAGSTMGAASLTLTVQARQLLPGIVQQQNNLLKAIEAQQHLLRLTVWGIKQLQARVLAVERYLRDQQLLGIWGCSGKIICTTAVPWNASWSNKSLDKIWDNMTWMEWEKEIDNYTNLIYNLLEESQNQQEKNELELLELDKWANLWNWFDISNWLWYIKIFIMIIGGLVGLRIVFAVLSIVNRVRQGYSPLSFQTRLPAPRGPDRPEGIEEEGGERDRDRSVRLVDGFLALIWDDLRSLCLFLYHRLRDLLLIAARIVELLGRRGWEALKYWWNLLQYWSQELKNSAISLLNATAVAVAEGTDRVIEALQRACRAILHIPRRIRQGLERLLL

SEQ ID NO: 88 - protein, 874 aa, Human immunodeficiency virus 1
MRVKGIRKNCQHLWRWGIMLLGMLMICSAAEQLWVTVYYGVPVWKEATTTLFCASDAKAYDKEVHNVWATHASVPTDPNPQEVVLENVTENFNMWKNNMVDQMHEDIISLWDQSLKPCVKLTPLCVTLNCTDLRNATNGNDTNTTSSSREMMGGGEMKNCSFNVTTSIRDKVQKEYALFYKLDVIPIDSRNNSNNSTEYNSYRLINCNTSVITQACPKVSFEPIPIHYCTPAGFAILKCKDKKFNGTGPCTKVSTVQCTHGIRPVVSTQLLLNGSLAEEEVIIRSENFTNNAKTIIVQLKEAVEINCTRPSNNTRKSIPIGPGRAFYTTGDIIGDIRKAHCNISRANWNNTLRQIVEKLGEQFGNNKTIIFKQSSGGDPEIVTHSFNCGGEFFYCNSTQLFNSTWNFNGTWNKNFNNTWNNTEGTNDTITLPCRIKQIINRWQEVGKAMYAPPISGQIRCSSNITGLILTRDGGNNGNETNGTEIFRPGGGNMRDNWRSELYRYKVVKIEPLGVAPTKAKRRVVQREKRAVGIGALFLGFLGAAGSTMGAASITLTVQARQLLSGIVQQQNNLLRAIEAQQHLLQLTVWGIKQLQARILAVERYLKDQQLLGIWGCSGKLICTTAVPWNTSWSNRSLNEIWNNMTWMEWEREIDNYTSLIYTLIEESQNQQEKNEQELLALDKWASLWNWFSITNWLWYIRIFIMIVGGLIGLRIVFAVLSVVNRVRQGYSPLSFQTHLPAQRGPDRPEGTEEEGGERDRDRSGRLVDGFLAIIWVDLRSLCLFSYHRLRDLLLIVTRIVELLGRRGWEVLKYWWNLLQYWIQELKNSAVSLFNAIAIAVAEGTDRIIEVVQRAYRAILHIPTRIRQGLERALL

SEQ ID NO: 89 - protein, 868 aa, Human immunodeficiency virus 1
MRVTGIRKNYQHLWRWGTMLLWRWGTMLLGILMICSAAGKLWVTVYYGVPVWKDATTTLFCASDAKAYDTEVHNVWATHASVPTDPNPQEVVLENVTEDFNMWKNNMVDQMHEDIISLWDQSLKPCVELTPLCVTLNCTDDVRNVTNNATNTNSSWGEPMEKGEIKFCSFNITTSIRNKVQKQYALFYKLDVVPIDNDSNNTNYRLISCNTSVITQACPKVTFEPIPIHYCAPAGFAILKCNNKTFNGTGPCTKVSTVQCTHGIRPVVSTHLLLNGSLAEEEVIIRSENFTDNTKTIIVQLKEAVEINCTRPNNNTRKGIHIGPGRAFYTTGEIIGDIRQAHCNLSRAKWNDTLKQIVIKLREQFGNKTIIFNQSSGGDPEIVMHTFNCGGEFFYCNTTQLFNSTWQNETSGSINITDIGENITLPCRIKQIVNMWQKVGKAMYAPPIKGQISCSSNITGLLLTRDGGNNGNETNGTEIFRPGGGNMKDNWRSELYRYKVVKIEPLGVAPTRAKRRVVQREKRAVTLGAMFLGFLGAAGSTMGAASMTLTVQARLLLSGIVQQQSNLLRAIEAQQHLLRLTVWGIKQLQARILAVERYLQDQQLLGIWGCSGKLICTTAVPWNASWSNKSQDEIWNNMTWMQWEKEIDNYTGLIYTLLEESQIQQEKNEQELLELDKWASLWNWFDITNWLWYIKIFIMIVGGLIGLRIVFTVLSIVNRVRKGYSPLSFQTHLPAPRGPDRPGGIEEEGGEQDRDRSGPLVNGFLALIWVDLRSLFLFSYHRLRDLLLIVARIVELLGRRGWEVLKYWWNLLQYWSQELKNSAISLLNATAVAVAEGTDRVIEALQRACRAILHIPRRIRQGLERLLL

SEQ ID NO: 90 - protein, 875 aa, Human immunodeficiency virus 1
MRVKGIRKNCQHLWRWGILLLGMLMICSAAEQLWVTVYYGVPVWRDANATLFCASDAKAYDTEAHNVWATHACVPTDPNPQEVELKNVTENFNMWKNNMVEQMQEDIISLWDQSLKPCVKLTPICVTLNCTDYVKNITNNATSTNSSWGKPMEKGEIKNCSFNVTTSIRDKVQKEYALFYRLDVVPIDNDSNNNDSTNTNYTNYRLISCNTSTITQACPKVSFQPIPIHYCAPAGFALLKCNDKKFNGTGPCKNVSTVQCTHGIKPVVSTQLLLNGSLAEEEIVIRSENFTNNAKTIIVQLNESVVINCTRPNNNTRKSIHIGPGRAFYATGDIIGDIRKAHCNISRANWNNTLRQIVEKLGEQFGNKTIVFNQSSGGDVEIVMHSFNCGGEFFYCNSTQLFNSTWNFNGTWNKNFNNTWNNTEGTNDTITLPCRIKQIINMWQGVGKAMYAPPISGQIRCSSNITGLILTRDGGNNNETNRTETFRPGGGDMRDNWRSELYKYKVVKIEPLGIAPTKARRRVVQREKRAVGTIGAMFLGFLGTAGSTMGAASLTLTVQARLLLSGIVQQQNNLLKAIEAQQHLLQLTVWGIKQLQARLLAVERYLGDQQLLGLWGCSGKLICTTTVPWNASWSNKSLDKIWDNMTWMEWEREIDNYTGLIYNLLEKSQNQQEKNELELLELDKWANLWNWFDITKWLWYIKIFIMIIGGLIGLRIVFAVLSVVNRVRQGYSPLSLQTRLPTQRGPDRPEGIAEEGGERDRDRSGPLVDGFLAIIWVDLRSLCLFSYHHLRDLLLIVTRIVELLGRRGWEALKYWWNLLLYWSQELKNSAVNLLNTTAIAVAEGTDRIIEVLQRIYRAFLHIPRRIRQGFERALL

SEQ ID NO: 91 - protein, 865 aa, Human immunodeficiency virus 1
MRVKEIRKNYQHLWKWGTMLLGMLMICSAAGNLWVTVYYGVPVWKEANTTLFCASDAKAYETEVHNVWATHACVPIDPNPQEVVLGNVTENFNMGKNNMVEQMHEDIISLWDESLKPCVKLTPLCVTLNCTDELKNATFRSNTTTNSSWEKMEKGEIKNCSFNITTNMRDKMQKEYALFYKLDVIPIDSRNNSNNSTEYNSYRLINCNTSVITQACPKISFEPIPIHYCTPAGFAILKCKDKKFNGKGPCTNVSTVQCTHGIRPVVSTQLLLNGSLAEKEVVIRSDNFTNNAKTIMVQLNVSVEINCTRPNNNTRRSIPIGPGRVFYTTEDIIGDIRQAHCNISRAQWNNTLKHIVEKLGKQFGNNKTIVFNHSSGGDPEIVMHSFNCRGEFFYCKSTKLFNSTWTRNNGTWTRNDTERSNSTEEHITLPCRIKQIINMWQEVGKAMYAPPIRGQIRCSSNITGILLTRDGGNDTSGTEIFRPGGGDMKDNWRSELYKYKVVRIEPLGVAPTEAKRRVVQREKRAVGIGAVFLGFLGAAGSTMGAAAVTLTVQARLLLSGIVQQQNNLLRAIEAQQRLLQLTVWGIKQLQARVLAVERYLRDQQLLGIWGCSGKIICTTAVPWNTSWSNRSLNEIWNNMTWMEWEKEIDNYTNLIYNLLEESQNQQEKNEQELLALDKWANLWNWFDISNWLWYIKIFIIIVGGLVGLRIVFAVLSIVNRVRQGYSPLSFQTRLPAPRGPDRPEGIEEEGGERDRDRSVRLVDGFLALIWDDLRSLCLFSYHRLRDLLLIVELLGRRGWEILKYWWNLLQYWGQELKNSAVSLLNATAIAVAEGTDRVIEVVQRAYRAILHIPTRIRQGLERALL

SEQ ID NO: 92 - protein, 861 aa, Human immunodeficiency virus 1
MRVKETRKNYQHLWRWGIMLLGMLMICSATEKLWVTVYYGVPVWKEATTTLFCASDAKAYDKEVHNVWATHACVPTDPSPQEVVLENVTENFNMWKNDMVEQMHEDIINLWDQSLKPCVRLTPLCVTLNCTNVNVTNLKNETNTKSSSGGEKMEEGEMKNCSFNITTSIRDKVQKQYALFYKLDVVPIDNDNTSYRLISCNTSVIKQACPKVSFEPIPIHFCAPAGFAILKCNDKKFNGTGPCTNVSTVQCTHGIRPVISTQLLLNGSLAEEEVVIRSENFTDNAKTIIVQLNETVEINCTRPSNNTRKSIPIGPGRAFYTTGDIIGDIRQAYCNISRAKWNNTLKQIVTKLREQFGNNKTIIFKQSSGGDPEIVTHSFNCGGEFFYCNSTKLFNSTWTWNNSTWNNTKRSNDTEEIITLPCRIKQIINRWQEVGKAMYAPPIEGQIRCLSNITGLLLTRDGGTNNTNTNETFRPGGGNMRDNWRSELYKYKVVQIEPLGVAPTKAKRRVVQREKRAVGIGALFLGFLGAAGSTMGAASITLTVQARQLLSGIVQQQRNLLRAIEAQQHMLQLTVWGIKQLRARVLAVERYLKDQQLLGIWGCSGRLICTTNVPWNTSWSNKSLNEIWDNMTWMQWEREIDNYTSLIYTLIEESQNQQEKNEQDLLALDKWASLWNWFSITNWLWYIRIFIMIVGGLVGLRIVFTVISIVTRVRQGYSPLSFQTRLPTPRGPDRPEGTEEEGGERDRDRSGRLVDGFLALFWDDLRSLCLFLYHRLRDLLLIAARIVELLGRRGWELLKYWWNLLQYWIQELKNSAVSLFNAIAIAVAEGTDWVIEISQRAFRAVLHIPVRIRQGLERALQ

SEQ ID NO: 93 - protein, 862 aa, Human immunodeficiency virus 1
MRVTGIRKNYQHLWRWGTMLLWRWGTMLLGILMICSAAGKLWVTVYYGVPVWKDATTTLFCASDAKAYDTEAHNVWATHACVPIDPNPQEVVLENVTENFNAWKNNMVEQMHEDMISLWDQSLQPCVRLTPLCVTLNCTDDVRNATSTNSSWGKPMEKGEIKNCSFNITTSIRDKVQKQYALFYKLDVVPIDNDSNNTNYRLISCNTSIITQACPKITFEPIPIHYCTPAGFALLKCNDKKFNGTGPCTKVSTVQCTHGIRPVVSTHLLLNGSLAEEEVIIRSENFTNNAKTIMVQLNVSVEINCTRPSNNTRKSIHIGPGRAFYTTGDIIGDIRKAHCNISRANWNNTLRQIVEKLGEQFGNNKTIVFNHSSGGDLEIVTHSFICGGEFFYCNSTKLFNSTWTWNNSTWNNTKRSNDTEEIITLPCRIKQIINMWQEVGKAMYAPPIRGKIRCSSNITGLLLTRDGGTNNTNTNETFRPGGGDMRDNWRNELYKYKVVRIEPLGIAPTEAKRRVVQREKRAVGIGAMFLGFLGTAGSTMGAASVALTVQARQLLPGIVQQQNNLLRAIDAQQHLLQLTVWGIKQLQARILAVERYLKDQQLLGFWGCSGKLICTTNVPWNTSWSNKSYSQIWENMTWMEWEREINNYTGLIYNLLEKSQNQQEKNEQELLELDKWASLWSWFDISNWLWYIKIFIIIVGGLVGLRIVFAVLSIINRVRQGYSPLSFQTHLPAPRGPDRPEGIAEEGGERDRDRSGRLVNGFLALIWVDLRSLCLFSYHHLRDLLLIVELLGRRGWEVLKYWWNLLLYWSQELKNSAISLLNATAVAVAEGTDRVIEALQRACRAILHIPRRIRQGLERLLL

SEQ ID NO: 94 - protein, 853 aa, Human immunodeficiency virus 1
MRVKETRKNYQHLWKWGTMLLGILMICSATENLWVTVYYGVPVWKEATTTLFCASDAKAYDKEVHNVWATHACVPTDPNPQEVELKNVTENFNMWKNNMVEQMQEDIISLWDQSLKPCVRLTPLCVTLNCTDLRNATNGNDTNTTSSSREMMGGGEMKNCSFNITTNIRDKVQKEYALFYKLDIVPIDNDNTNYRLISCNTSVVTQACPKVSFEPIPIHFCAPAGFAILKCNDKKFNGKGPCTNVSTVQCTHGIRPVISTQLLLNGSLAEEEVVIRSENFTNNVKTIIVQLNETVEINCTRPNNNTRRSIPIGPGRVFYTTEDIIGDIRQAHCNLSRTQWNNTLKQIVTKLREQFGNKTIIFNQSSGGDPEIVMHTFNCGGEFFYCNTTKLFNSTWNDTTINRTEGSNNTRNITLPCRIKQIINLWQEVGKAMYAPPIQGQISCSSNITGLLLTRDGGNNNETNRTETFRPGGGNMRDNWRSELYKYKVVKIEPLGVAPTKAKRRVVQREKRAVGIGALFLGFLGAAGSTMGAASVTLTVQARQLLSGIVQQRNNLLRAIEAQQRMLQLTVWGIKQLRARVLAVERYLKDQQLMGIWGCSGKLICTTTVPWNASWSNKSLNEIWDNMTWMEWEREIDNYTSLIYTLIEESQNQQEKNELELLELDKWASLWNWFSITNWLWYIRLFIMIVGGLVGLRIVFTVISIVTRVRQGYSPLSFQTRLPTPRGPDRPGGIEEEGGEQDRDRSIRLVDGFLALIWDDLRSLCLFSYHRLRDLLWIVELLGRRGWEALKYLWNLLQYWSQELKKSAVSLFNATAIAVAEGTDWVIEVIQRAFRAFIHIPTRVRQGLERALQ

SEQ ID NO: 95 - protein, 849 aa, Human immunodeficiency virus 1
MRVKGIRKNCQHLWRWGILLLGMLMICSATEKLWVTVYYGVPVWKETTTTLFCASDAKAYVAEKHNVWATHACVPTDPNPREVVMGNVTEEFNIWNNSMVEQMHEDIISLWEQSLKPCVKLTPLCVSLKCTDLKNDTNTNSSSGRMIMEKGEIKNCSFNITTGIRGKVQEYSLFYKLDVVQMDEDNTSYRLINCNTSVITQACPKVSFQPIPIHYCAPAGFAILKCKDKKFNGTGSCKNVSTVQCTHGIRPVISTQLLLNGSLAEGEVVIRSENFTDNAKTIIVQLKDPVKINCTRPNNNTRKSIPIGPGRAFYATGDIIGDIRQAHCNISTTKWNKTLGQVVKKLREQFKNKTIVFKQSSGGDPEVVMHSFNCGGEFFYCNTSQLFNSTWNSTSLFNSTNGTITLQCRIKQIINRWQEVGKAMYAPPIEGQIRCLSNITGLLLVRDGGINVTNNTGTEVFRPGGGDMRDNWRSELYKYKVIKIEPLGVAPTRAKRRVVQREKRAVGLGAMFLGFLGAAGSTMGAASITLTVQARQLLSGIVQQQRNLLRAIEAQQHMLQLTVWGIKQLQARVLAVERYLQDQQLLGIWGCSGKLICTTTVPWNTSWSNKSLNQIWDNMTWMQWEKEIDNYTGLIYTLLEESQNQQEKNEHELLELDKWASLWNWFNITNWLWYIKIFIMIIGGLIGLRIVFAVLSIVNRVRQGYSPISFQTRLPAPRGPDRPDGIEEEGGDRDRDRSGRLVDGFLTLIWVDLRSLCLFSYRRLRDLLLIAARIVELLGHRGWEALKYWWNLLQYWIQELKNSAVNLLNTTAIAVAEGTDRVIEVVQRAYRAILNIPTRIRQGFERALL

SEQ ID NO: 96 - protein, 873 aa, Human immunodeficiency virus 1
MRVKEIRKNCQRLWRWGTMLLGMLMICSAAEQLWVTVYYGVPVWRDANATLFCASDAKAYDTEVHNVWATHASVPTDPNPQEVVLGNVTENFNMWKNDMVEQMHEDVISLWDQSLKPCVKLTPICVTLNCTDYVKNITNNATSTNSSWGEPMEKGEIKNCSFNITTSMKDKVQKTYALFYKLDVVPIDNDSNNNDSTNTNYTNYRLISCNTSVIKQACPKVSFDPIPIHYCTPAGFAILKCRDKKFNGTGPCKNVSTVQCTHGIRPVVPTQLLLNGSLAEEEIVIRSENFSDNAKTIIVHLNESVEINCTRLNNNTRKSIHMGPGRAFYATGEIIGDIRQAHCNISRAKWNNTLKQIAIKLREQFGNNKTIIFKQSSGGDPEIVTHSFNCGGEFFYCNSTQLFNSTWNFNGTWNKNFNNTWNNTEGTNDTITLPCRIKQIINMWQKVGKAMYAPPISGQIRCTSNITGLLLTRDGGNDTSGTEIFRPGGGNMKDNWRSELYKYKVVQIEPLGVAPTEAKRRVVQREKRAVGIGAVFLGFLGAAGSTMGAAAVTLTVQARLLLSGIVQQQNNLLKAIEAQQHLLRLTVWGIKQLQARLLAVERYLGDQQLLGLWGCSGKLICTTAVPWNTSWSNRSLNEIWNNMTWMEWEKEIDNYTNLIYNLLEESQNQQEKNEKELLELDKWANLWNWFDISNWLWYIRIFIMIVGGLIGLRIVFIVLSVVNRVRQGYSPLSLQTRLPTQRGPDRPEGTEEEGGERDRDTSGRLVDGFLAIIWVDLRSLFLFSYHRLRDLLLIVTRIVELLGRRGWEILKYWWNLLQYWGQELKNSAVSLLNATAITVAEGTDRVIEVLQRAGRAILHIPTRIRQGLERILL

SEQ ID NO: 97 - protein, 863 aa, Human immunodeficiency virus 1
MRVKGIRRNYQHLWRWGIMLLGMLMICSATEQLWVTVYYGVPVWKEANTTLFCASDAKAYKTEAHNVWATHASVPTDPNPQEIVLENVTENFNMWKNNMAEQMHEDIINLWDQSLKPCVELTPLCVTLNCTDELKNATFRSNTTTNSSWEKMEKGEIKNCSFNVTTSIRDKMQKEYALFYRLDVVPIDNDNTSYRLISCNTSVITQACPKISFEPIPIHYCVPAGFAILKCNNKTFNGTGPCTNVSTVQCTHGIKPVVSTQLLLNGSLAEEDVVIRSENFTDNTKTIIVQLKEAVEINCTRPNNNTRKGIHIGPGRAFYTTGEIIGNIRQAHCNLSRAKWNDTLKQIVIKLREQFGNKTIVFNQSSGGDVEIVMHSFNCGGEFFYCNTTQLFNSTWNANDIRNVTRGSNRTTGGNDTLILPCRIKQIVNMWQEVGKAMYAPPIKGQIKCSSNITGLLLTRDGGNNGNETNGTEIFRPGGGDMRNNWRSELYKYKVVRIEPLGVAPTKARRRVVQREKRAVTLGAMFLGFLGAAGSTMGAASMTLTVQARLLLSGIVQQQSNLLRAIEAQQRLLQLTVWGIKQLQARILAIERYLKDQQLLGIWGCSGKIICTTAVPWNASWSNKSQDEIWNNMTWMQWEREIDNYTGLIYNLIEESQNQQEKNEQELLALDKWANLWNWFDITKWLWYIKIFIMIVGGLIGLRIVFTVLSIVNRVRKGYSPLSFQTRLPAQRGPDRPEGIEEEGGERDRDRSGPLVDGFLAIFWVDLRSLFLFSYRHLRDLLLIVARIVELLGRRGWELLKYWWNLLQYWSQELKSSAVSLLNATAIAVAEGTDRILEVLQRAYRAILHIPVRIRQGLERALL

SEQ ID NO: 98 - protein, 870 aa, Human immunodeficiency virus 1
MRVKGIRKNYQHLWRWGMMLFGMLMICSAAGNLWVTVYYGVPVWREATTTLFCASDAKAYETEVHNVWATHACVPTDPSPQEVVLENVTEDFNMWKNNMVDQMHEDIISLWDESLKPCVKLTPLCVTLNCTDDVRNVTNNATNTNSSWGEPMEKGEIKFCSFNITTSIRNKVQKQYALFYKLDVIPIDSRNNSNNSTEYNSYRLINCNSSTITQACPKVTFEPIPIHYCAPAGFAILKCNNKKFNGTGPCNNVSTVQCTHGIRPVVSTQLLLNGSLAEKEVVIRSDNFTNNAKTIIVQLNESVVINCTRPNNNTRKRISMGPGRVYYTTGEIIGDIRRAHCNISRAQWNNTLKHIVEKLGKQFGNNKTIFNHSSGGDPEIVMHSFNCRGEFFYCKSTKLFNSTWTRNNGTWTRNDTERSNSTEEHITLPCRIKQIINMWQGVGKAMYAPPIRGQIRCSSNITGLILTRDGGNNDTRGTEIFRPGGGDMKDNWRSELYRYKVVKIEPLGIAPTKAKRRVVQREKRAVGTIGAMFLGFLGTAGSTMGAASLTLTVQARLLLSGIVQQQNNLLRAIEAQQHLLQLTVWGIKQLQAKVLAVERYLRDQQLLGIWGCSGRLICTTNVPWNASWSNKSLDKIWNNMTWMEWDREINNYTSLIYSLIEESQNQQEKNEQDLLALDKWASLWNWFDITNWLWYIKIFIMVVGGLVGLRIIFAVLSIVNKVRQGYSPLSLQTHLPARRGPDRPEGIEGEGGERDRDRSVRLVDGFLALFWDDLRSLCLFLYHRLRDLLLIVTRTVELLGRRGWEALKYCWNLLQYWSQELKNSAVSLFNAIAIAVAEGTDRIIEVVQRICRAIRHIPRRIRQGFERALL

SEQ ID NO: 99 - protein, 859 aa, Human immunodeficiency virus 1
MRVRGIQRNWPQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWDQSLKPCVKLTPLCVTLNCTDVKVNATSNGTTTYNNSIDSMNGEIKNCSFNTTTEIRDKKQKVYALFYRLDIVPLDNNSSEYRLINCNTSTITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEKQWDQTLYRVSEKLKEHFPNKTIKFAPSSGGDLEITTHSFNCRGEFFYCNTSKLFNSTYNSTQMHNDTGSNSTITLPCRIKQIINMWQEVGRAMYAPPIAGNITCKSNITGLLLTRDGGTNNNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQTDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILVTARAVELLGRSSLRGLQRGWEALKYLGSLVQYWGLELKKSAISLLDTIAIAVAEGTDRIIELIQRICRAIRNIPRRIRQGFEAALL

SEQ ID NO: 100 - protein, 857 aa, Human immunodeficiency virus 1
MRVMGIQRNCQQWWIWGSLGFWMLMIYNVMGNLWVTVYYGVPVWKEAKTTLFCASDAKAYDTEVHNVWATYACVPTDPNPQEMVLENVTENFNMWKNNMVDQMHEDIISLWDQSLKPCVKMTPLCVTLNCSNAKKDNTTIDNEMKGEIKNCSFNITTELRDKKKQVYALFYKLDIVPLNSNSSEYRLINCNTSAITQACPKVSFDPIPIHYCAPAGYAILKCNNETFNGTGPCNNVSTVQCTHGIRPVVSTQLLLNGSLAEKEIIIRSENLTDNVKTIIVHLNESVEINCTRPNNNTRRSIRIGPGQAFYATGEIIGDIRQAYCNISGEKWNETLQRVGKKLKEHFPNKTIKFAPSSGGDLEITTHSFNCRREFFYCNTSGLFNGTYNGNGTYNGTGTDTNSTITIPCRIKQIINMWQEVGRAMYAPPIEGNITCKSNITGLLLVRDGGTENNTETNNTETFRPGGGDMRDNWRSELYRYRVVEIKPLGIAPTKAKRRVVERGKRAVGIGAVFLGFLGVAGSTMGAASITLTVQARQVLSGIVQQQSNLLRAIEAQQHLLQLTVWGIKQLQTRVLAIERYLKDQQLLGIWGYSGKLICTTAVPWNSSWSNRSQEDIWNNMTWMQWDREINNYTNTIYRLLEDSQNQQEKNEQDLLALDSWKNLWNWFDITNWLWYIRIFIMIVGGLIGLRIIFAVLSIVNRVRQGYSPLSLQTLTPNPRELDRLGRIEEGGGEQDRDRSIRLVSGFLALAWDDLRSLCLFSYHRLRDFILIAARAAELLGRSSLKGLQRGWEILKYLGSLIQYWGLELKKSAINLLDTIAIVVAEGTDRIIELIQRICRAICNIPRRIRQGFEAALQ

SEQ ID NO: 101 - protein, 873 aa, Human immunodeficiency virus 1
MRVRGILRNWQQWWIWGILGFWMLMICNVVGNLWVTVYYGVPVWREAKTTLFCASDAKAYEREVHNVWATHACVPTDPNPQELVLENVTENFNMWKNDMVDQMHQDIISLWDESLKPCVKLTPLCVTLKCVNVTKNSNATVNSNATVNNNTMGEEIKNCSFNATTEIRDKKQNVYALFYRLDIVPLNENNDNSSYRLINCNTSTITQACPKVTFDPIPIHYCTPAGYAILKCNDKTFNGTGPCHNVSTVQCTHGIKPVISTQLLLNGSLAEEEIIIRSENLTNNVKTIIVHLNKSVEIVCTRPGNNTRKSVRIGPGQTFYATGDIIGDIRQAHCNISRTAWNKTLQEVGKKLAEHFPNKTIEFKPSSGGDLEVTTHSFNCRGEFFYCNTSKLFNSTYNSTYNSTYNSNSTNSNSNSTITLQCRIKQIINMWQKVGRAIYAPPIAGNITCRSNITGLLLTRDGGNNNDTGNNNDTEIFRPGGGDMKDNWRNELYKYKVVEVKPLGIAPTGAKRRVVEREKRAVGLGAVFLGFLGAAGSTMGAASMTLTVQARQLLSGIVQQQNNLLRAIEAQQHMWQVTVWGIKQLQARVLALERYLKDQQLLGLWGCSGKLICTTNVPWNSSWSNKSLTDIWENMTWMQWDKEISNYTDTIYRLLEVSQNQQEKNEKDLLALDSWNNLWNWFSITKWLWYIKIFIMIVGGLIGLRIIFGVLSIVKRVRQGYSPLSFQTLTPNPRGPDRLGRIEEEGGEQDKDRSIRLVNGFLALAWDDLRNLCLFSYHQLRDFILIVARAVELLGHSSLRGLQRGWEALKYLGSLVQYWGLELKRSAISLLDTTAIAVAEGTDRIIEVIQRICRAIRNIPTRIRQGFEAALLQ

SEQ ID NO: 102 - protein, 848 aa, Human immunodeficiency virus 1
MRVRGIQRNWPQWWIWGILGFWMIIICRVVGNLWVTVYYGVPVWTEAKATLFCASDAKAYEKEVHNVWATHSCVPTDPNPQEIVLGNVTENFNMWENDMVDQMHEDVISLWDQSLKPCVKLTPLCVTLNCTNANVTVNATSDGSIKEEIKNCSFNTTTEIRDKKQKVYALFYRPDIVPLSGSNSSEYILINCNTSTVTQACPKVSFEPIPIHYCAPASYAILKCNNKTFNGTGPCQNVSTVQCTHGIKPVVSTQLLLNGSLAEGEIIIRSENLTNNAKTIIVHLNESIEIVCTRPNNNTRKSIRIGPGQTFFATGDIIGNIRQAHCNISEEKWNKTLQEVSRKLREHFPNKTIIFNSSSGGDLEITTHSFNCGGEFFYCNTTKLFNDSALSAFNKTSNETITLPCRIKQIINMWQGVGRAMYAPPIAGNITCNSSITGLLLTRDGGTNNTEIFRPGGGNMKDNWRSELYKYKVVEIKPLGVAPTEAKRRVVEREKRAVGIGAVLLGFLGAAGSTMGAASITLTAQARQLLSGIVQQQSNLLKAIEAQQHMLQLTVWGIKQLQARVLAIERYLQDQQLLGIWGCSGKLICTTTVPWNSSWSNKSQTDIWDNMTWMQWDREISNYTNTIYRLLEESQNQQEQNEKDLLALDKWQNLWSWFSITNWLWYIKIFIIIVGGLIGLRIILGVLSIVRRVRQGYSPLSFQTLIPNPRGPDRLGGIEEEGGEQDRDRSVRLVSGFLSLAWDDLRSLCLFCYHRLRDFILVTARAVELLGRSSLRGLQKGWEALKYLGNLVQYWGLELKKSAISLLDTIAIAVAEGTDRIIEFIQRICRAIRNIPRRIRQGLEAALQ

SEQ ID NO: 103 - protein, 853 aa, Human immunodeficiency virus 1
MRVRGILRNYQQWWIWGSLGFWMLMIYNVGGNLWVTVYYGVPVWKEAKTTLFCASDAKAYDTEVHNVWATHACVPTDPDPQEIVLENVTENFNMWENDMVDQMHEDIISLWDESLKPCVKLTPLCVTLKCTNVTSTGNTTRGNNTSENREEMKNCSFNTTTEIRDKKQKVYALFYKPDVVPLKENSSEYILINCNTSTVTQACPKVSFDPIPIHYCAPAGFAILKCNNKTFNGTGPCNNVSTVQCTHGIKPVVSTQLLLNGSLAEEEIIIRSENLTDNAKTIIVHLNESIEIVCTRPGNNTRKSIRIGPGQAFYATGDIIGDIRQAYCNISKATWNKTLQEVGKELAKHFPNKTINFNSSSGGDLEITTHSFNCGGEFFYCNTTKLFNNSLLNNTADNSTSTITLQCRIKQIINMWQGVGQAMYAPPIAGNITCKSNITGLLLLRDGGDTSTNGTEIFRPGGGNMKDNWRSELYKYKVVEVKPLGIAPTGAKRRVVEREKRAVGIGAVLLGFLGAAGSTMGAASITLTAQARQVLSGTVQQQSNLLRAVEAQQHMLQLTVWGIKQLQTRVLAIERYLKDQQLLGIWGCSGKLICTTNVPWNSSWSNKSQEEIWENMTWMQWDREISNYTGTIYRLLEESQNQQEKNEQDLLALDSWKNLWNWFDISNWLWYIKIFIIIVGGLIGLRIIFGVLSIVKRVRQGYSPLSFQTLIPNPRGPDRLERIEEEGGEQDRGRSIRLVSGFLAIAWDDLRSLCLFSYHQLRDFILIAVRAVELLGHSSLRGLQRGWEALKYLGSLVQYWGLELKRSAISLLDTIAIVVAEGTDRIIEFIQRICRAIRNIPTRIRQGFEAALQ

SEQ ID NO: 104 - protein, 867 aa, Human immunodeficiency virus 1
MRVMGIQRNCQQWWIWGILGFWILMICNVMGNLWVTVYYGVPVWKEAKATLFCASDAKAYEKEVHNIWATHACVPTDPNPQELVLENVTENFNMWDNDMVDQMHQDIISLWDQSLKPCVKLAPLCVTLNCTNATVTATRNGSDIMNTTSNDGEMKNCSFNVTTELRDKKKKEYALFYRLDIVPLNEGSGNANQNNSNYSDYRLINCNTSAITQACPKVTFDPIPIHYCTPAGYAILKCNDKTFNGTGPCHNVSTVQCTHGIRPVVSTQLLLNGSLAEGEIMIRSENLTNNAKTIIVHLNKSVEIVCTRPNNNTRKSVRIGPGQTFYATNDIIGDIRQAHCNISEEKWNKTLQQVGKKLAEHFPNKTIEFKPSSGGDLEVTTHSFNCRGEFFYCNTSGLFNGTFDGTESNSTSNATITIPCRIKQIINMWQKVGRAIYAPPIAGNITCRSNITGLLLVRDGGNDNKTNDTETFRPGGGDMRDNWRSELYKYKVVEVKPLGVAPTKAKRRVVQREKRAVGIGAVFLGFLGVAGSTMGAASMTLTVQARQVLSGIVQQQSNLLRAIEAQQHLLQLTVWGIKQLQARVLALERYLRDQQLLGMWGCSGKLICTTAVPWNSSWSNKSQEDIWGNMTWMQWDKEISNYTNTIYRLLEDSQNQQERNEKDLLALDSWKNLWSWFDITNWLWYIKIFIMIIGGLIGLRIIFAVLSIVNRVRQGYSPLSLQTLTPNPRGPDRLGRIEEEGGEQDKDRSIRLVNGFLALAWDDLRNLCLFSYHRLRDFILIVARAVELLGRNSLRGLQRGWETLKYLGSLIQYWGLELKKSAISLLDTTAIAVAEGTDRIIELIQRICRAICNIPRRIRQGLEAALQ

SEQ ID NO: 105 - protein, 869 aa, Human immunodeficiency virus 1
MRVRGIQRNWPQWWIWGILGFWMIIICRVVGNLWVTVYYGVPVWREAKTTLFCASNAKAYEKEVHNVWATHACVPTDPNPQEIVLGNVTENFNMWKNDMVDQMHEDVISLWDQSLKPCVKMTPLCVTLNCTDVKVNATSNGTTTYNNSIDSMNGEIKNCSFNTTTELRDKKQKAYALFYRPDIVPLPGKDNSKDNSSEYEEYILINCNSSTITQACPKVSFEPIPIHYCAPASYAILKCNNETFNGTGPCKNVSTVQCTHGIKPVISTQLLLNGSLAEKEIIIRSENLTNNVKTIIVHLKESVEINCTRPNNNTRKSIRIGPGQTFYATGDIIGNIRQAHCNISREKWNTTLKRVKEKLKEHFPNKTIKFAPSSGGDLEITTHTFNCRGEFFYCNTSKLFNSTYVNRTDMNDDTGNNSTITLPCRIKQIINMWQEVGRAMYAPPIAGNITCNSSITGLLLTRDGGNNTENTETFRPGGGNMKDNWRNELYKYKVVEIKPLGVAPTEAKRRVVEREKRAVGLGAVFLGFLGAAGSTMGAASITLTVQARQLLSGIVQQQNNLLRAIEAQQHMLQLAVWGIKQLQARVLAIERYLQDQQLLGIWGCSGKLICTTSVPWNSSWSNRSQEDIWNNMTWMQWDREISNYTDTIYRLLEVSQNQQEQNEKDLLALDKWQNLWSWFSITNWLWYIRIFIMIVGGLIGLRIVFAVLSLVNRVRQGYSPLSFQTLTPSPRGPDRLGGIEEEGGEQDRDRSIRLVSGFLSLAWDDLRSLCLFSYHRLRDFILIAARAAELLGRSSLRGLQRGWEILKYLGSLAQYWGLELKKSAINLLDTIAIAVAEGTDRIIEVIQRICRAIYNIPRRIRQGFEASLL

SEQ ID NO: 106 - protein, 849 aa, Human immunodeficiency virus 1
MRVRGIPRNWQQWWIWGILGFWMLMICNVVGNLWVTVYYGVPVWTEAKTTLFCASDAKAYEREVHNVWATYACVPTDPNPQEMVLENVTENFNMWKNDMVEQMHEDIISLWDQGLKPCVKLTPLCVTLNCSNAKKDNTTIDNEMKGEIKNCSFNITTELRDKKQQVYALFYKLDIVPLNSNSSEYRLINCNTSTITQACPKVNFDPIPIHYCAPAGYAILKCNNKTFNGTGPCQNVSTVQCTHRIKPVVSTQLLINGSLAEGEIIIRSENLTDNVKTIIVHLNESVEIVCTRPNNNTRKSMRIGPGQTFYATGEIIGDIRQAHCNISKEKWNNTLQEVREKLREHFPNKTIKFAPHSGGDPEITTHSFNCRGEFFYCNTSQLFNSTYNSTQMHNDTGSNSTITLPCKIKQIINMWQGVGRAMYAPPIEGNITCTSNITGLLLTRDGGTNNTEIFRPGGGDMRNNWRSELYKYKVVEIKPLGIAPTKAKRRVVERGKRAVGIGAVLFGFLGAAGSTMGAASIALTAQARQLLSGIVQQQSNLLKAIEAQQHMWQVTVWGIKQLQARVLAMERYLKDQQLLGLWGCSGKLICTTTVPWNSSWSNKSQTDIWDNMTWMQWDREINNYTNTIYKLLEDSQNQQEKNEKDLLALDSWNNLWNWFSITKWLWYIKIFIMIVGGLIGLRIILGVLSIVRRVRQGYSPLSFQTLTPNPRELDRLGRIEEGGGEQDRDRSVRLVSGFLALAWDDLRSLCLFCYHRLRDFILVTARAVELLGRSSLKGLQRGWEALKYLGNLVQYWGLELKKSAISLFDTIAITVAEGTDRIIELVQRICRAIRNIPRRIRQGFEAALL

SEQ ID NO: 107 - protein, 874 aa, Human immunodeficiency virus 1
MRVRGIQRNWPQWWIWGILGFWIIIMCRVMGNMWVTVYYGVPVWREAKTTLFCASDAKGYEKEVHNAWATHACVPTGPNPQEMVLENVTENFNMWKNNMVDQMHEDIINLWDQSLKPCVRLTPLCVTLKCVNVTKNSNATVNSNATVNNNTMGEEIKNCSFNATTEIRDKKQKAYALFYRPDIVPLNENSSSENNSSEYILINCNTSTITQACPKVSFDPIPIHYCAPASYAILKCNNETFNGTGPCQNVSTVQCTHGIKPVISTQLLLNGSLAEEDIIIRSENLTNNAKTIIVHLNQSVEIVCTRPGNNTRKSMRIGPGQTFYATNDIIGNIRQAHCNISEGKWNETLLRVKKKLEEHFPNKTIKFEPSSGGDLEITTHTFNCRGEFFYCDTSTLFNHTYVSAYMNNTDVSADRKNDTQSNSTITLPCRIRQIINMWQEVGRAIYAPPIAGNITCRSNITGLLLVRDGGNTTNSTETFRPEGGNMKDNWRSELYKYKVVEIRPLGIAPTGAKRRVVEREKRAVGIGAVFLGFLGVAGSTMGAASMTLTVQARQVLSGVVQQQSNLLQAIEAQQHLLQLTVWGIKQLQTRVLALERYLRDQQLLGIWGCSGKIICTTAVPWNTSWSNKSQEDIWNNMTWMQWDREINNYTNTIYKLLEESQNQQEKNEQDLLALDSWNSLWNWFSITKWLWYIRIFIIIVGSLIGLRIIFGVLSIVKRVRQGYSPLLSQTLTPNPREPDRLGRIEEGGGEQDRDRSVRLVNGFLALVWDDLRSLCLFCYHRLRDFILVTARVVELLGRSSLRGLQKGWEALKYLGSLVQYWGLELKKSAINLLDTIAIAVGEGTDRIIEVIQRICRAIYNIPRRIRQGFEASLL

SEQ ID NO: 108 - protein, 869 aa, Human immunodeficiency virus 1
MRVRGILRNYQQWWIWGSLGFWMLMIYNVGGNLWVTVYYGVPVWTDAKTTLFCASDAKAYDKEVHNVWATHACVPTDPNPQELVLENVTENFNMWKNDMVNQMHEDIISLWDESLKPCVKLTPLCVTLNCTNATVTATRNGSDIMNTTSNDGEMKNCSFNITTELRDKKRKEYALFYRLDIVPLDENNSSEKSSENSSEYYRLINCNTSAITQACPKVTFDPIPLHYCAPAGYAILKCKDKTFNGTGPCSNVSTVQCTHGIKPVVSTRLLLNGSLAEGEIIIRSENLTNNVKTIIVHLKEPVEINCTRPNNNTRESIRIGPGQTFYATGDIIGDIRQAHCNISREKWNKTLQEVGKKLAEHFPNKTIKFAPHSGGDLEITMHSFNCRGEFFYCNTSGLFNGTYMPTYMPNGTESNSNSTITIPCRIKQIINMWQEVGRAMYAPPIEGNITCNSNITGLLLVRDGGINKTNNTETFRPGGGDMRNNWRSELYKYKVVEIKPLGVAPTEAKRRVVEREKRAALGAMFLGFLGAAGSNMGAASITLTAQARQLLSGIVQQRSNLLRAIEAQQHLLQLTVWGVKQLQARVLAMERYLKDQQLLGLWGCSGKLICTTSVPWNSSWSNRSQEEIWNNMTWMEWDREISNYTNTIYRLLEDSQNQQEKNEKDLLALDSWKNLWSWFDITNWLWYIKIFIMIIGGLIGLRIVFAVLSIVNRVRQGYSPLSFQTLTPSPRGPDRLGRIEEEGGEQDKDRSVRLVSGFLSLAWDDLRSLCLFSYHRLRDLILIAARAVELLGHSSLRGLQRGWEILKYLGSLAQYWGLELKRSAISLLDTIAITVAEGTDRIIEIIQRICRAICNIPRRIRQGFETALL

SEQ ID NO: 109 - protein, 849 aa, Human immunodeficiency virus 1
MRVMGILRNCQQWWIWGVLGFWMLMICNVVGNLWVTVYYGVPVWKEAKTTLFCASNAKAYEREVHNIWATHACVPTDPNPQEMVLKNVTENFNMWKNDMVDQMHEDVISLWDQSLKPCVKLAPLCVTLNCTNVTVNDTLHQNFTDMKNCSFNVTTELRDKKQKVYALFYRLDVVPLGDNNSSYRLINCNTSTIAQACPKVNFDPIPIHYCTPAGYAILKCNDKTFNGTGPCKNVSTVQCTHEIKPVVSTQLLLNGSLAEEGIIIRSENLTDNAKTIIVHLNESVEINCTRPGNNTRQSIRIGPGQAFYATGAIIGDIRQAHCNISKDEWEKTLKRVSEKLKEHFPNKTIEFKPSSGGDLEVTTHSFNCRREFFYCNTSKLFNSTYNSTQMHNDTGSNSTITLPCKIKQIINMWQGVGQAMYAPPIKGNITCKSNITGILLTRDGGNLTNGTETFRPGGGDMKDNWRSELYRYRVVEIKPLGIAPTKAKRRVVQREKRAVGIGALFLGFLGTAGSTMGAASLTLTVQARQLLSSIVQQQSNLLRAIEAQQHMLQLTIWGIKQLQTRVLAVERYLKDQQLLGMWGCSGKLICTTAVPWNASWSNKSQEEIWGNMTWMQWDREISNYTDIIYRLLEESQNQQERNEKDLLALDSWNNLWNWFNITNWLWYIKIFIMIVGGVIGLRIIFAVLSLVNRVRQGYSPLSFQTLTPNPRELDRLGRIEEEGGEQGRDRSIRLVNGFLAIAWDDLRSLCLFSYRRLRDFILIAARAAELLGRSSLRGLQRGWETLKYLGSLIQYWGLELKKSAISLFDTIAIAVAEGTDRIIELIQRICRAIRNIPRRIRQGLEAALQ

SEQ ID NO: 110 - protein, 855 aa, Human immunodeficiency virus 1
MRVMGIQRNCQQWWIWGILGFWMLMIYNVVGNLWVTIYYGVPVWKEAKATLFCASDAKAYDTEVHNVWATHACVPTDPDPQEMVLGNVTENFNMWKNDMADQMHEDIISLWDQGLKPCVKLTPLCVTLHCTNTNITNENRTIGDKLNEEMKNCSFNTTTELRDKKQQVYALFYKPDVVPLNGGEHNETGEYILINCNSSTITQACPKVSFEPIPIHYCAPAGFAILKCNNKTFNGTGPCHNVSTVQCTHGIRPVVSTQLLLNGSLAEEEIIIRSENLTDNVKTIIVHLNKSVEIVCTRPNNNTRKSIRIGPGQTFFATNDIIGDIRQAYCNISAEKWNKTLERVEEKLKEHFPNKTIKFNSSSGGDLEITTHSFNCRGEFFYCNTSNLFNGTYHGTQSTNSTNSTITLQCRIKQIINMWQKVGRAMYAPPIAGNITCKSNITGLLLLRDGGTENNDTETFRPGGGNMRDNWRSELYKYKVVEVKPLGIAPTTAKRRVVERDKRAVGIGAVLLGFLGAAGSTMGAASMALTVQARQLLSGIVQQQSNLLRAVEAQQHMLQLTVWGIKQLQARVLALERYLKDQQLLGIWGCSGRLICTTAVPWNSSWSNKTQGEIWENMTWMQWDKEINNYTNTIYRLLEESQTQQEQNEKDLLALDSWKNLWNWFDITKWLWYIKIFIMVVGGLIGLRIIFAVLSIVNSVRQGYSPLSLQTLTPNPRGPDRLERIEEEGGEQDRNRSIRLVNGFLALAWDDLRSLCLFSYHHLRDFILVTARAVELLGRSSLKGLQRGWEALKYLGNLVQYWGLELKKSAISLLDTTAIAVAEGTDRIIELVQRICRAILNIPTRIRQGFEAALQ

SEQ ID NO: 111 - protein, 861 aa, Human immunodeficiency virus 1
MRVRGIPRNWPQWWTWGILGFWMIIICRVVGNLWVTVYYGVPVWTEAKTTLFCASDAKAYEREVHNVWATHSCVPTDPNPQEIVLGNVTENFNMWENDMVDQMHQDIISLWDQSLKPCVKMTPLCVTLNCSNAKKDNTTIDNEMKGEIKNCSFNITTEIRDKKQKVHALFYRLDIVPLNEGSGNANQNNSNYSDYRLINCNTSTVTQACPKVTFDPIPIHYCAPARYAILKCNNNTFNGTGPCNNVSTVQCTHGIKPVVSTQLLLSGSLAEEEIVIRSENLTNNAKIIIVHLNESVEIVCTRPNNNTRRSIRIGPGQTFYATGEIIGDIRQAHCNISAKQWNTTLERVKEKLREHFPNKTIKFEPHSGGDPEITTHSFNCGGEFFYCNTSQLFNSTYNSTYMSNNTGENSNETITLPCRIKQIINMWQQVGRAMYAPPIAGNITCNSSITGLLLTRDGGNNNDTGNNNDTEIFRPGGGDMRDNWRSELYKYKVVELKPLGIAPTEAKRRVVKREKRAVGIGAVLFGFLGAAGSTMGAASIALTAQARQVLSGIVQQQNNLLRAIEAQQHVLQLTVWGIKQLQTRVLAIERYLKDQQLLSLWGCSGKLICTTTVPWNSSWSNKSLTDIWDNMTWMQWDREISNYTGTIYRLLEDSQSQQEKNEKDLLELDKWNNLWNWFDISNWLWYIKIFIIIVGGLIGLRIIFAVLSIINRVRQGYSPLLFQTLTPNPRGLDRLGRIEEEGGEQDKDRSIRLVNGFLALAWEDLRSLCLFSYHQLRDFILIVARAVELLGRRGWEALKYLGNLVLYWGLELKKSAVSLLDTIAIAVAGGTDRIIEVVQRICRAIRNIPTRIRQGLEAALL

SEQ ID NO: 112 - protein, 851 aa, Human immunodeficiency virus 1
MRVRGILRNWQQWWIWGILGFWMVMICNVMGNLWVTVYYGVPVWQEAKTTLFCASDAKAYEKEVHNVWATHACVPTDPSPQEIVLENVTENFNMWKNDMVEQMHEDIISIWDQSLKPCVTLTPLCVTLNCTDVKVNATSNGTTTYNNSIDSMNGEIKNCSFNTTTEIRDKKKQVYALFYKLDIVPLNSNSSEYRLINCNTSAVTQACPKVSWDPIPIHYCAPAGYAILKCNNKTFNGTGPCTNVSTVQCTHRIKPVVTTQLLLNGSLAEKEIIIRSENLTNNIKTIIVHLNESIEIVCTRPNNNTRKSVRIGPGQTFFATGDIIGDIRKAHCNISEDKWNETLQRVGKKLVEHFPNKTIKFAPSSGGDLEVTTHSFNCKGEFFYCNTTKLFDDSERINTTTTTIILPCRIKQFINMWQGVGRAMYAPPIAGNITCTSNITGLLLTRDGGTNNTEIFRPGGGNMKDNWRNELYKYKVVEVKPLGVAPTKAKRRVVEREKRAVGLGAVFLGFLGAAGSTMGAASITLTVQARQLLFGIVQQQSNLLKAIEAQQHMWQVTVWGIKQLQARVLAIERYLQDQQLLGIWGCSGKLICTTNVPWNSSWSNKSQTDIWDNMTWMQWDKEISNYTDTIYRLLEVSQNQQEENEKDLLALDKWQNLWNWFSITNWLWYIRIFIMIVGGLIGLRIILGVLSIVRRVRQGYSPLSFQTLIPNPRGPDRLGGIEEEGGEQDRDRSIRLVSGFLALAWDDLRNLCLFSYHRLRDFILIVVRAVELLGRNSLRGLQRGWEALKYLGSLGQYWGLEIKKSAISLLDTIAIVVAEGTDRIIEFIQRFCRAIRNLPRRIRQGFEAALL

SEQ ID NO: 113 - protein, 871 aa, Human immunodeficiency virus 1
MRVTGIRKNYQHLWRWGTMLLWRWGTMLLGMLMICSAAGNLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDDVRNVTNNATNTNSSWGEPMEKGEIKNCSFNITTSIRDKVQKEYALFYKLDVVPIDNDSNNTNYRLISCNTSVITQACPKVSFEPIPIHYCAPAGFAILKCNDKKFNGTGPCTNVSTVQCTHGIKPVVSTQLLLNGSLAEEEVVIRSENFTNNAKTIIVQLNESVEINCTRPNNNTRKSIRIGPGQTFYATGDIIGDIRQAHCNISRAQWNNTLKHIVEKLGKQFGNNKTIVFNHSSGGDPEIVMHSFNCGGEFFYCNTTKLFNSTWTRNNGTWTRNDTERSNSTEEHITLPCRIKQIINMWQEVGKAMYAPPIRGQIRCSSNITGLLLTRDGGNDTSGTEIFRPGGGDMRDNWRSELYKYKVVKIEPLGVAPTKAKRRVVQREKRAVGIGAVFLGFLGAAGSTMGAASITLTVQARQLLSGIVQQQNNLLRAIEAQQHLLQLTVWGIKQLQARVLAVERYLKDQQLLGIWGCSGKLICTTAVPWNSSWSNKSLNEIWNNMTWMEWEREIDNYTGLIYTLIEESQNQQEKNEQELLELDKWASLWNWFDISNWLWYIKIFIMIVGGLIGLRIVFAVLSIVNRVRQGYSPLSFQTRLPAPRGPDRPEGIEEEGGERDRDRSIRLVSGFLALAWDDLRSLCLFSYHRLRDLLLIVTRIVELLGRRGWEALKYWWNLLQYWSQELKNSAVSLLNATAIAVAEGTDRVIEALQRACRAILHIPRRIRQGLERALL

SEQ ID NO: 114 - protein, 862 aa, Human immunodeficiency virus 1
MRVRGIQRNWPQWWIWGILGFWMLMICNVVGNLWVTVYYGVPVWKEAKTTLFCASDAKAYEKEVHNVWATYACVPTDPNPQEIHLENVTEEFNMWKNDMVDQMHEDIISLWDQSLKPCVQLTPLCVTLNCTNVNVTNLKNETNTKSSSGGEKMEEGEMKNCSFNITTSIRDKVQKEYALFYKLDVVPIDNDSNNTNYRLISCNTSVITQACPKVTFEPIPIHYCTPAGFAILKCKDKKFNGTGPCKNVSTVQCTHGIKPVISTQLLLNGSLAEEEIIIRSENITNNAKTIIVQLNESVEINCTRPGNNTRKSVRIGPGQTFYATGEIIGDIRQAHCNLSRAKWNDTLKQIVIKLREQFGNKTIVFNQSSGGDPEIVMHSFNCGGEFFYCNTTQLFNSTWNSTSLFNSTNGTITLQCRIKQIINMWQEVGKAMYAPPIEGNITCKSNITGLLLVRDGGTEPNDTETFRPGGGNMKDNWRSELYKYKVVKIEPLGVAPTKAKRRVVQREKRAVGTIGAMFLGFLGAAGSTMGAASMTLTVQARLLLSGIVQQQNNLLRAIEAQQHLLQLTVWGIKQLQARILAVERYLKDQQLLGLWGCSGKLICTTAVPWNTSWSNKSQTDIWDNMTWMEWEREIDNYTGLIYTLIEESQNQQEKNEQELLELDKWASLWNWFDITKWLWYIKIFIMIVGGLVGLRIVFAVLSIVNRVRKGYSPLSFQTLTPNPRGPDRLGRIEEEGGEQDRDRSIRLVSGFLALAWDDLRSLCLFSYHQLRDFILIVARAVELLGRSSLRGLQRGWEALKYLGSLVQYWGLELKKSAISLLDTIAIAVAEGTDRIIEVIQRICRAIRNIPRRIRQGFERALL

SEQ ID NO: 115 - protein, 869 aa, Human immunodeficiency virus 1
MRVTGIRKNYQHLWRWGTMLLWRWGTMLLGILMICSAAGKLWVTVYYGVPVWRDAETTLFCASDAKAHETEVHNIWATHACVPTDPNPQEVVLGNVTENFNMWKNNMVEQMHEDIISLWDESLKPCVKLTPICVTLNCTDDVRNVTNNATNTNSSWGEPMEKGEIKNCSFNMTTELRDKKQKVHALFYKLDIVPLNSNSSEYRLINCNTSAITQACPKVSFEPIPIHYCAPAGFAILKCNDKKFNGTGPCTNVSTVQCTHGIRPVVSTQLLLNGSLAEEEVVIRSENFTNNAKTIMVQLNVSVEINCTRPNNNTRKSIHIGPGRAFYTTGDIIGDIRQAHCNISRAQWNNTLKHIVEKLGKQFGNNKTIVFNHSSGGDPEITTHSFNCGGEFFYCNSTKLFNSTWTRNNGTWTRNDTERSNSTEEHITLPCRIKQIVNMWQRVGQAMYAPPIRGQIRCSSNITGLLLTRDGGNDTSGTEIFRPGGGDMRNNWRNELYKYKVVRIEPLGVAPTRAKRRVVEREKRAVGLGAVFLGFLGAAGSTMGAASLTLTVQARQVLSGIVQQQSNLLKAIEAQQHLLKLTVWGIKQLQARVLAVERYLRDQQLLGIWGCSGKLICTTTVPWNASWSNKSLNEIWNNMTWMEWEKEIDNYTNLIYNLLEESQNQQEKNEQDLLALDKWANLWNWFDISNWLWYIKIFIIIVGGLIGLRIVFAVLSIINRVRQGYSPLSLQTLIPNPRGPDRPGGIEEEGGEQGRDRSIRLVNGFLALAWDDLRNLCLFSYHRLRDLLLIVTRIVELLGRRGWEALKYWWNLLQYWSQELKNSAISLLNATAVAVAEGTDRVIEALQRACRAILHIPRRIRQGLERLLL

SEQ ID NO: 116 - protein, 862 aa, Human immunodeficiency virus 1
MRVKETRKNYQHLWKWGTMLLGMLMICSAAEQLWVTVYYGVPVWKEATTTLFCASDAKAYDTEVHNVWATHACVPTDPSPQEVVLENVTENFNMWKNDMVEQMHTDIISLWDQSLKPCVKLTPLCVTLNCTDYVKNITNNATSTNSSWGKPMEKGEIKNCSFNITTSIRNKVQKQYALFYKLDIVPIDNDNTSYRLINCNTSTITQACPKVSFDPIPIHYCAPAGYAILKCNNKTFNGTGPCNNVSTVQCTHGIKPVVSTQLLLNGSLAEGEIIIRSENLTNNAKTIIVHLNKSVEINCTRPSNNTRKSIRIGPGQAFYATGDIIGDIRKAHCNISGTKWNHTLEQVMEELKKHFPNKTIKFNSSSGGDLEITTHSFNCRGEFFYCNTSGLFNSTWNDTTINRTEGSNNTRNITLPCRIKQIINMWQGVGRAMYAPPIAGNITCKSNITGILLTRDGGNNNSTNETFRPGGGDMRDNWRSELYKYKVVEIKPLGIAPTKAKRRVVEREKRAVGIGAVFLGFLGTAGSTMGAASITLTVQARQLLSGIVQQQSNLLRAIEAQQHMLQLTVWGIKQLQTRVLAIERYLKDQQLLGIWGCSGKLICTTNVPWNSSWSNKSQSEIWDNMTWMQWDREISNYTDTIYRLLEDSQNQQEKNEKDLLALDSWKNLWNWFDITNWLWYIRIFIMIVGGLIGLRIIFAVLSIVNRVRQGYSPLSFQTRLPAPRGPDRPEGIEEEGGERDRDRSVRLVDGFLALIWDDLRSLCLFSYHRLRDFILIAARTVELLGHSSLKGLRLGWEGLKYLWNLLQYWIQELKNSAVSLLNATAIAVAEGTDRVIEVVQRAYRAILHIPTRIRQGLERALL

SEQ ID NO: 117 - protein, 852 aa, Human immunodeficiency virus 1
MRVKETRKNYQHLWKWGTMLLGMLMICSAAEQLWVTVYYGVPVWKEATTTLFCASDAKAHETEVHNIWATHACVPTDPNPQEVVLGNVTENFNMWKNDMVEQMHTDIISLWDQSLKPCVELTPLCVTLHCTDLGNATNTMEKGEIKNCSFNMTTELRDKKQKVYALFYRLDIVPIDNDNTSYRLINCNTSVIKQACPKVTFEPIPIHYCTPAGFAILKCNDKNFNGTGPCKNVSTVQCTHGIRPVVSTQLLLNGSLAEKEIIIRSENLTDNAKTIIVHLNKSVEINCTRPSNNTRKSVRIGPGQTFYATGDIIGDIRQAHCNISRAKWNNTLKQIVTKLREQFKNKTIVFNQSSGGDLEITTHSFNCRGEFFYCNTTQLFNSTWKNDTEVSNNTKGNDTITLPCRIKQIVNMWQEVGRAMYAPPIEGNITCNSNITGILLTRDGGNNGNETNGTEIFRPGGGNMRDNWRNELYKYKVVEIKPLGVAPTEAKRRVVEREKRAVGIGAVFLGFLGAAGSTMGAASITLTVQARQLLTGIVQQQSNLLRAIEAQQHMLQLTVWGIKQLQTRVLAIERYLKDQQLLGLWGCSGKLICTTAVPWNSSWSNKTYNDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRPGGIEEEGGEQGRDRSIRLVNGFLALAWDDLRNLCLFSYHQLRDFILIVARAVELLGRSSLRGLQRGWEALKYLGSLVQYWGLELKKSAISLLDTIAIAVAEGTDRVIEVVQRAYRAILHIPTRIRQGLERLLL

SEQ ID NO: 118 - protein, 862 aa, Human immunodeficiency virus 1
MRVRGIQRNWPQWWIWGILGFWMLMICNVVGNLWVTVYYGVPVWKEAKTTLFCASDAKAYEKEVHNVWATHACVPTDPSPQEVVLENVTENFDMWKNNMVEQMQEDVISLWDQSLKPCVKLAPLCVTLNCTDYVKNITNNATSTNSSWGKPMEKGEIKFCSFNITTSIRNKVQKQYALFYKLDVVQMDEDNTSYRLISCNTSTITQACPKVTFDPIPIHYCAPAGFAILKCNNKTFNGTGPCTNVSTVQCTHGIKPVVSTQLLLNGSLAEEEIIIRSENLTNNAKTIIVHLNESVEIVCTRPNNNTRKSIHIGPGRAFYATGEIIGDIRQAHCNLSRAKWNDTLKQIVIKLREQFGNKTIIFNQSSGGDPEITTHSFNCGGEFFYCNSTQLFNSTWNFNGTWNKNFNNTWNNTEGTNDTITLPCKIKQIINMWQRVGQAMYAPPISGQIRCSSNITGLILTRDGGNDTSGTEIFRPGGGDMRDNWRSELYKYKVVKIEPLGVAPTKAKRRVVQREKRAVGIGALFLGFLGAAGSTMGAASMTLTVQARQLLSGIVQQQSNLLKAIEAQQHLLQLTVWGIKQLQARILAVERYLKDQQLLGIWGCSGKLICTTTVPWNASWSNKSLNEIWDNMTWMEWEREIDNYTGLIYNLIEESQTQQEKNEQELLELDKWASLWNWFDITKWLWYIKIFIMIIGGLIGLRIVFTVLSIVNRVRKGYSPLSFQTLTHHQREPDRPERIEEGGGEQDRDRSGRLVDGFLAIIWVDLRSLCLFSYHRLRDLLLIVTRIVELLGRRGWEVLKYWWNLLQYWSQELKNSAVSLLNATAIAVAEGTDRIIEVIQRICRAIRNIPRRIRQGLERALL

SEQ ID NO: 119 - protein, 870 aa, Human immunodeficiency virus 1
MRVKETQMNWPNLWKWGTLILGLVIICSASDNLWVTVYYGVPVWKDAETTLFCASDAKAYDTEVHNVWATYACVPTDPNPQEIHLENVTEEFNMWKNDMVDQMHEDIISLWDESLKPCVKLTPLCVTLNCTDDVRNVTNNATNTNSSWGEPMEKGEIKNCSFNITTSIRDKVQKEYALFYKLDVVPIDNDSNNTNYRLISCNTSVITQACPKVSFEPIPIHYCAPAGYAILKCNDKKFNGTGPCNNVSTVQCTHGIKPVVTTQLLLNGSLAEGEIIIRSENITNNAKTIIVQLNESVVINCTRPNNNTRKSIRIGPGQAFYATGDIIGNIRQAHCNISRANWNNTLRQIVEKLGEQFGNNKTIVFNHSSGGDPEIVTHSFNCAGEFFYCNTTKLFNSTWTRNNGTWTRNDTERSNSTEEHITLPCRIKQIINMWQEVGKAMYAPPIRGQIRCSSNITGLLLTRDGGNNNSTNETFRPGGGNMKDNWRSELYKYKVVQIEPLGIAPTKAKRRVVEREKRAVGLGAVFLGFLGTAGSTMGAASLTLTVQARQVLSGIVQQQRNLLRAIEAQQHLLKLTVWGIKQLQARVLAIERYLQDQQLLGMWGCSGKLICTTNVPWNSSWSNKSQTDIWDNMTWLQWDKEISNYTSLIYTLIEESQNQQEKNEQDLLALDKWASLWSWFDISNWLWYIKIFIIIVGGLIGLRIVFAVLSIINRVRQGYSPLSLQTLIPNPRGPDRLGRIEEEGGEQDRDRSIRLVSGFLALAWDDLRSLCIFSYHRLRDFILIAARTVELLGHSSLKGLRLGWEGLKYLGNLLLYWGQELKNSAINLLDTIAIAVAGWTDRVIEIGQRAGRAILNIPRRIRQGFERALL

SEQ ID NO: 120 - protein, 861 aa, Human immunodeficiency virus 1
MRVTGIRKNYQHLWRWGTMLLWRWGTMLLGILMICSAAGKLWVTVYYGVPVWRDADTTLFCASDAKAYDTEAHNVWATHASVPTDPNPQEIVLENVTENFNMWKNNMVEQMHEDIISLWDQSLKPCVQLTPLCVTLNCTNVNVTNLKNETNTKSSSGGEKMEEGEMKNCSFNITTEIRDKKQKVHALFYKLDIVPLNSNSSEYRLINCNTSAITQACPKVSFDPIPIHYCTPAGYAILKCNNKKFNGTGPCKNVSSVQCTHGIKPVISTQLLLNGSLAEEEVVIRSENFTNNAKTIMVQLNVSVEINCTRPNNNTRRSIPIGPGRAFYTTGDIIGDIRKAHCNISRAQWNNTLKHIVEKLGKQFGNNKTIIFKPSSGGDPEIVMHSFNCGGEFFYCNTSGLFNSTWNSTSLFNSTNGTITLQCRIKQIINMWQGVGRAMYAPPIAGNITCKSNITGLLLVRDGGTEPNDTETFRPGGGDMKDNWRSELYKYKVVRIEPLGVAPTRAKRRVVEREKRAIGLGAMFLGFLGAAGSTMGAASVTLTVQARLLLSGIVQQQNNLLRAIEAQQHLLRLTVWGIKQLQARVLAVERYLRDQQLLGIWGCSGKIICTTAVPWNTSWSNRSLNEIWNNMTWMEWEKEIDNYTNLIYNLLEESQNQQEKNEQELLALDKWANLWNWFDISNWLWYIRIFIMIVGGLVGLRIVFAVLSIVKRVRQGYSPLSFQTRLPAPRGPDRPEGIEEEGGERDRDRSVRLVDGFLALIWDDLRSLCLFSYHHLRDLLLIVARIVELLGRRGWEALKYWWNLLQYWIQELKNSAISLLNATAVAVAEGTDRVIEALQRACRAILHIPRRIRQGFEAALL

SEQ ID NO: 121 - protein, 866 aa, Human immunodeficiency virus 1
MRVMGIQRNCQQWWIWGILGFWMLMICNVMGNLWVTVYYGVPVWKEANTTLFCASDAKAYEREVHNVWATHASVPTDPNPQEVVLENVTEDFNMWKNNMVEQMQEDVISLWDQSLQPCVKLTPLCVTLNCTDLRNATNGNDTNTTSSSREMMGGGEMKNCSFNITTEIRDKKQKVYALFYKLDVVPIDNDSNNTNYRLISCNTSAVTQACPKVTFDPIPIHYCTPAGFAILKCRDKKFNGTGPCNNVSTVQCTHGIKPVVTTQLLLNGSLAEEEIVIRSENFTDNAKTIIVQLKEAVEINCTRPNNNTRKGIHIGPGRAFYATGEIIGDIRQAHCNVSRSEWNKTLQQVATQLRKHFNKTIIFNSSSGGDLEITTHSFNCRGEFFYCNTSGLFNSTWNDTTINRTEGSNNTRNITLPCRIKQFINMWQEVGRAMYAPPIAGNITCRSNITGLLLTRDGGNNGNETNGTEIFRPGGGDMRNNWRSELYKYKVVEIKPLGIAPTKARRRVVQREKRAVGIGAVFLGFLSAAGSTMGAASITLTVQARQLLTGIVQQQSNLLKAIEAQQHMLQLTVWGVKQLQARVLAVERYLRDQQLLGIWGCSGRLICTTAVPWNTSWSNKSLNEIWDNMTWMEWEREIDNYTSLIYTLIEESQNQQEKNEQELLELDKWANLWNWFSITNWLWYIRIFIMIVGGLIGLRIIFGVLSIVKRVRQGYSPLSFQTRLPAPRGPDRPEGIEEEGGERDRDRSGRLVDGFLALIWDDLRSLCLFSYHRLRDLILIAARIVELLGHSSLKGLRLGWEALKYLWNLLLYWGQELKNSAISLLNTTAIVVAEGTDRVIEVLQRAGRAILNIPRRIRQGFEAALL

SEQ ID NO: 122 - protein, 864 aa, Human immunodeficiency virus 1
MRVTGIRKNYQHLWRWGTMLLWRWGTMLLGILMICSAAGKLWVTVYYGVPVWREAKTTLFCASDAKAYEKEVHNVWATYACVPTDPNPQEMVLENVTENFNMWKNNMVDQMHEDIISLWDESLKPCVKLTPLCVTLHCTDLGNATNTMEKGEIKNCSFNTTTEIRDKKQKVHALFYRLDVVPIDNDNTSYTLINCNTSVITQACPKVTFEPIPIHYCAPAGFAILKCNNKKFNGTGPCTNVSTVQCTHGIRPVVSTQLLLNGSLAEGEIIIRSENLTDNAKTIIVHLNESVEIVCTRPNNNTRKSVRIGPGQTFYATGAIIGDIRQAYCNISRAKWNNTLKQIVTKLREQFGNNKTIIFKPPSGGDLEITMHHFNCRGEFFYCNTTQLFNSTWNFNGTWNKNFNNTWNNTEGTNDTITLPCKIKQIINMWQGVGRAMYAPPISGQIRCSSNITGLLLTRDGGTNNTEIFRPGGGNMRDNWRSELYKYKVVKIEPLGVAPTKAKRRVVQREKRAVGIGALFLGFLGAAGSTMGAASMTLTVQARQVLSGIVQQQRNLLRAIEAQQHLLQLTVWGIKQLQARILAVERYLKDQKFLGLWGCSGKIICTTAVPWNASWSNKSLDDIWNNMTWMQWEREIDNYTGLIYSLIEESQTQQEKNEQELLQLDKWASLWNWFDITNWLWYIRLFIMIVGGLVGLRIVFTVLSIVNRVRKGYSPLSFQTLTHHQREPDRPERIEEGGGEQGRDRSVRLVSGFLALFWDDLRSLCLFCYHRLRDFILIAARTVELLGHSSLKGLRRGWEGLKYLWNLLQYWIQELKNSAISLLNATAVAVAEGTDRVIEALQRACRAILHIPRRIRQGLERLLL

SEQ ID NO: 123 - protein, 871 aa, Human immunodeficiency virus 1
MRVRGIQRNWPQWWIWGILGFWMIIICRVVGNLWVTVYYGVPVWKDAETTLFCASDAKSYETEAHNIWATHACVPTDPSPQEVVLGNVTENFNMWKNDMVEQMHEDIISLWDQSLKPCVELTPLCVTLNCTDDVRNVTNNATNTNSSWGEPMEKGEIKNCSFNITTSIRNKVQKQYALFYKLDVVQIDDNNSTNTSYRLINCNTSAITQACPKVSFDPIPIHYCAPAGYAILKCNNKTFNGTGPCHNVSTVQCTHGIRPVISTQLLLNGSLAEEEVVIRSENFTNNAKTIMVQLNVSVEINCTRPNNNTRKSIHIGPGRAFYTTGDIIGDIRQAHCNISRAQWNNTLKHIVEKLGKQFGNNKTIIFKPSSGGDPEIVMHSFNCRGEFFYCNTSKLFNSTWTRNNGTWTRNDTERSNSTEEHITLPCRIKQIINMWQRVGQAMYAPPIAGNITCNSSITGLLLTRDGGNDTSGTEIFRPGGGNIKDNWRSELYKYKVVQIEPLGVAPTRAKRRVVEREKRAVGIGAMIFGFLGAAGSTMGAASMALTVQARQLLSGIVQQQSNLLMAIEAQQHLLKLTVWGIKQLRARVLAVERYLKDQQLLGIWGCSGKHICTTNVPWNSSWSNKSLDEIWNNMTWIEWEREINNYTGLIYNLLEKSQNQQEKNEQDLLALDKWASLWSWFDISNWLWYIKIFIIIVGGLIGLRIVFAVLSLVNRVRQGYSPLSLQTLLPTPRGPDRPEGTEEEGGEQGRDRSIRLVSGFLALAWDDLRSLCRFSYHRLRDFILIVARTVELLGRSSLKGLRLGWEGLKYLGNLLLYWGQELKISAISLLDTTAIAVAGWTDRVIEIGQRLCRAIRNIPRRIRQGAERALQ

SEQ ID NO: 124 - protein, 858 aa, Human immunodeficiency virus 1
MRVKETQMNWPNLWKWGTLILGLVIICSASDNLWVTVYYGVPVWRDADTTLFCASDAKAHETEVHNVWATHACVPTDPNPQEIHLENVTEEFNMWKNNMVEQMHTDIISLWDQSLKPCVRLTPLCVTLNCTDELKNATFRSNTTTNSSWEKMERGEIKNCSFNITTSIRDKVQKEYALFYKLDIVPLNSNSSEYRLINCNTSVIKQACPKISFDPIPIHYCAPAGFAILKCKDKKFNGTGPCQNVSTVQCTHRIKPVVSTQFLLNGSLAEEDIIIRSENITNNAKTIIVQLNESVVINCTRPNNNTRRSIPIGPGRVFYTTEDIIGDIRQAHCNLSRAKWNDTLKQIVIKLREQFGNKTIVFNQSSGGDLEIVMHSFNCGGEFFYCNSTQLFNSTWFNSTWSTEGSNNTEGSDTITLPCRIKQIVNMWQGVGKAMYAPPIRGQIRCSSNITGILLTRDGGTNGTNETETFRPGGGNMKDNWRSELYRYKVVKIEPLGIAPTKAKRRVVEREKRAIGLGAMFLGFLGTAGSTMGAASLTLTVQARQLMSGIVQQQNNLLRAIEAQQHMLKLTVWGIKQLQARVLALERYLKDQQLLGLWGCSGKLICTTTVPWNSSWSNKSQTDIWDNMTWMQWDREISNYTNTIYRLLEDSQNQQEKNEKDLLALDSWKNLWNWFDITKWLWYIKIFIMIVGGLIGLKIVFAVLSIINRVRQGYSPLSFQTLIPNPRGPDRPGGIEEEGGEQDRDRSIRLVNGFLALIWVDLRSLFLFSYHRLRDLLLIVTRIVELLGRRGWEALKYWWNLLQYWSQELKNSAINLLDTIAIAVAEGTDRIIEVIQRICRAIRNIPTRIRQGLERALL

SEQ ID NO: 125 - protein, 860 aa, Human immunodeficiency virus 1
MRVKGIRKNYQHLWKWGTMLLGMLMICSATEKLWVTVYYGVPVWKEATTTLFCASDAKAYDTEVHNVWATYACVPTDPNPQELVLENVTENFDMWKNNMVEQMHEDIINLWDQSLKPCVKLTPICVTLNCTDYVKNITNNATSTNSSWGKPMEKGEIKNCSFNMTTELRDKKQKVYSLFYKLDVVQMDEDNTSYRLISCNTSVITQACPKISFEPIPIHYCTPAGYAILKCNDKNFNGTGPCKNVSSVQCTHGIKPVISTQLLLNGSLAEEEIIIRSENLTNNVKTIIVHLNKSVEINCTRPSNNTRTSIRIGPGQAFYATGDIIGDIRKAHCNISRANWNNTLRQIVEKLGEQFGNNKTIVFNHSSGGDPEITTHSFNCGGEFFYCNTTKLFNSTWTWNNSTWNNTKRSNDTEEIITLPCRIKQIINMWQEVGKAMYAPPIQGVIRCESNITGLILTRDGGNNNSTNETFRPGGGDMRDNWRSELYKYKVVRIEPLGVAPTEAKRRVVQREKRAVGTIGAMFLGFLGAAGSTMGAASVTLTVQARLLLSGIVQQQNNLLKAIEAQQHLLRLTVWGIKQLQARVLAIERYLQDQQLLGIWGCSGKLICTTNVPWNTSWSNRSLNEIWNNMTWMEWEKEIDNYTNLIYNLLEESQIQQEKNEQELLALDKWANLWNWFDISNWLWYIRIFIIIVGGLVGLRIVFAVLSIVNKVRQGYSPLSFQTHLPAQRGPDRPEGIEEGGGEQDRDRSVRLVDGFLAIIWVDLRSLCLFSYHHLRDLLLIVARIVELLGRRGWEVLKYWWNLLKYWSQELKNSAVSLLNATAIAVAEGTDRIIELIQRICRAICNIPRRIRQGFERALL

SEQ ID NO: 126 - protein, 866 aa, Human immunodeficiency virus 1
MRVKETRKNYQHLWRWGIMLLGMLMICSAAEQLWVTVYYGVPVWKEAKTTLFCASNAKAYDTEAHNVWATHACIPTDPNPQEIVLENVTESFNMWKNDMVDQMHEDVISLWDQSLKPCVQLTPLCVTLNCTNVNVTNLKNETNTKSSSGGEKMEEGEMKNCSFNVTTELRDKKKKEYALFYRLDIVPLNEGNNSNSSYYRLINCNTSTITQACPKVSFEPIPIHFCAPAGFAILKCNDKKFNGTGPCKNVSTVQCTHGIKPVVSTQLLLNGSLAEKEIIIRSENLTNNAKIIIVQLNESVEINCTRPGNNTRKSIRIGPGQTFYATGDIIGNIRQAHCNISRTQWNNTLKQIAIKLREQFGNKTIIFNQSSGGDPEIVTHSFNCGGEFFYCKSTKLFNSTWNSTSLFNSTNGTITLQCRIKQIINRWQEVGKAMYAPPIEGNITCKSNITGLLLVRDGGINVTNNTGTEVFRPGGGDMKDNWRNELYKYKVVEIKPLGVAPTRARRRVVEREKRAVGLGAVFLGFLGAAGSTMGAAAVTLTVQARQLLFGIVQQQSNLLRAIEAQQRMLQLTVWGIKQLQTRVLAIERYLKDQQLLGMWGCSGKLICTTAVPWNSSWSNKTYNDIWDNMTWLQWDKEISNYTDTIYRLLEESQNQQERNEKDLLELDKWASLWNWFNITNWLWYIKIFIMIIGGLIGLRIIFAVLSIVNRVRQGYSPLSFQTLTPNPRGPDRLGRIEEEGGEQDKDRSIRLVNGFSALIWDDLRNLCLFSYHQLRDFILVTARAVELLGRSSLRGLQRGWEALKYLGSLVQYWGLELKKSAISLLDTIAIAVANWTDRVIEVVQRAYRAILHIPTRIRQGFEAALQ

SEQ ID NO: 127 - protein, 1003 aa, Human immunodeficiency virus 1
FFRENLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQIPIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVKQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKIATESIVIWGKTPKFKLPIQKETWETWWTEYWQATWIPEWEFVNTPPLVKLWYQLEKEPIVGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 128 - protein, 1003 aa, Human immunodeficiency virus 1
FFRENLAFPQGKAREFPSEQTRANSPTSRELQVWGGDNNSLSEAGDDRQGTVSFSFPQITLWQRPIVTIKIGGQQKEALLDTGADDTVLEEMNLPGRWKPKIIGGIGGFIKVKQYDQILIEICGHKAIGTVLVGPTPANIIGRNLLTQIGCTLNFPISPIETVPVRLKPGMDGPKVKQWPLTEEKIKALIEICTELENEGKISKIGPENPYNTPVFAIKKKDGTKWRKLVDFRELNKRTQDFWEVQLGIPHPAGLKKKKSVTVLDVGDAYFSVPLDKEFRKYTAFTIPSINNETPGIRYQYNVLPQGWKGSPSIFQSSMTKILEPFRKQNPEIVIYQYMDDLYVGSDLEIEQHRTKIEELRQHLLKWGFYTPDKKHQKEPPFLWMGYELHPDKWTVQPIVLPEKDSWTVNDIQKLVGKLNWASQIYAGIKVKQLCRLLRGTKALTEVVPLTEEAELELAENREILKEPVHGVYYDPSKDLVAEIQKQGLGQWTYQIYQEPYKNLKTGKYAKMRGAHTNDVKQLTEAVQKIATESIVIWGKTPKFRLPIQKETWEAWWMEYWQATWIPEWEFVNTPPLVKLWYQLEKEPIVGAETFYVDGAANRDTKLGKAGYVTDRGRQKVVSLTDTTNQKTELQAIHLALQDSGLEVNIVTDSQYAIGIIQAQPDRSESELVSQIIEQLIKKEKVYLAWVPAHKGIGGNEQVDKLVSSGIRKVLFLDGIDKAQEDHEKYHSNWKAMASDFNLPPVVAKEIVACCDKCQLKGEAMHGQVDCSPGIWQLDCTHLEGKVILVAVHVASGYIEAEVIPAETGQETAYFILKLAGRWPVTTIHTDNGSNFTSTAVKAACWWAGIKQEFGIPYNPQSQGVVESINKELKKIIKQVRDQAEHLKTAVQMAVFVHNFKRKGGIGGYSAGERMIDIIATDIQTTELQKQITKLQNFRVYFRDSRDPLWKGPAKLLWKGEGAVVIQDNSEIKVVPRRKAKIIRDYGKQMAGDDCVASRQDED

SEQ ID NO: 129 - protein, 1003 aa, Human immunodeficiency virus 1
FFREDLAFLQGKAREFSSEQTRANSPTRGELQVWGRDNNSLSEAGADRQGTVSLSFPQITLWQRPLVTVKIGGQLKEALLDTGADDTVLEEMSLPGRWKPKMIGGIGGFIKVRQYDQILVEICGHKAIGTVLIGPTPVNIIGRDLLTQIGCTLNFPISPIDTVPVKLKPGMDGPKVKQWPLTEEKIKALVEICTEMEKEGKISKIGPENPYNTPIFAIKKKDSTKWRKLVDFRELNRRTQDFWEVQLGIPHPAGLKQKKSVTVLDVGDAYFSVPLDEDFRKYTAFTIPSTNNETPGIRYQYNVLPQGWKGSPAIFQSSMTRILEPFRKQNPDLVIYQYMDDLYVGSDLEIGQHRTKIEELREHLLKWGFTTPDKKHQKEPPFLWMGYELHPDKWTVQPIMLPEKDSWTVNDIQKLVGKLNWASQIYPGIKVKQLCKLLRGAKALTEVIPLTKEAELELAENREILKEPVHGAYYDPSKDLIAEIQKQGQGQWTYQIYQDPFKNLKTGKYARMRGAHTNDVRQLTEAVQKITTESIVIWGKIPKFKLPIQKETWETWWTEYWQATWIPEWEFVNTPPLVKLWYQLEKEPIIGAETFYVDGAANRETKLGKAGYVTNKGRQKVVSITDTTNQKTELQAILLALQDSGLEVNIVTDSQYAIGIIQAQPDKSESELVSQIIEELIKKEKVYLTWVPAHKGIGGNEQIDKLVSAGIRKVLFLDGIDQAQEEHEKYHSNWRAMASDFNIPPVVAKEIVASCDKCQLKGEAIHGQVDCSPGIWQLDCTHLEGKIILVAVHVASGYIEAEIIPTETGQETAYFLLKLAGRWPVKTVHTDNGSNFTSTTVKAACWWAGVKQEFGIPYNPQSQGVVESMNNELKKIIGQIRDQAEHLKTAVQMAVFIHNFKRKGGIGGYSAGERIVDIIATDIQTKELQKQITKIQNFRVYYRDNRDPLWKGPAKLLWKGEGAVVIQENSDIKVVPRRKVKIIRDYGKQMAGDDCVASGQDED

SEQ ID NO: 130 - protein, 1003 aa, Human immunodeficiency virus 1
FFREDLAFPQGEAREFSSEQTRANSPTRRELQVWGRDSNSLSEAGADRQGTVSFNFPQITLWQRPLVTIKIGGQLKEALLDTGADDTVLEDMNLPGKWKPKMIGGIGGFIKVRQYDQIPIEICGHKAVGTVLVGPTPVNIIGRNLLTQLGCTLNFPISPIETVPVKLKPGMDGPKVKQWPLTEEKIKALVEICTELEKEGKISKIGPENPYNTPVFAIKKKDSTKWRKVVDFRELNKKTQDFWEVQLGIPHPSGLKKKKSVTVLDVGDAYFSVPLDKDFRKYTAFTIPSVNNETPGVRYQYNVLPQGWKGSPAIFQCSMTKILEPFRKQNPDIVIYQYMDDLYVGSDLEIGQHRAKIEELRQHLLRWGFTTPDKKHQNEPPFLWMGYELHPDKWTVQPIELPEKDSWTVNDIQKLVGKLNWASQIYPGIKVRQLCKLLRGTKALTEVIPLTEEAELELAENREILREPVHGVYYDPTKDLIAEIQKQEQGQWTYQIYQEPFKNLKTGKYARTRGAHTNDVKQLTEAVQKVATESIVIWGKTPKFKLPIQKETWEAWWTEYWQATWIPEWEFVNTPPLVKLWYQLEKEPIEGAETFYVDGASNRETKLGKAGYVTNRGRQKVVPLTDTTNQKTELQAIYLALQDSGSEVNIVTDSQYALGIIQAQPDKSESELVNQIIEQLIKKEKIYLAWVPAHKGIGGNEQVDKLVSAGIRKILFLDGIDKAQEEHEKYHNNWRAMASDFNLPPIVAKEIVASCDKCQLKGEAIHGQVDCSPGIWQLDCTHLEGKVILVAVHVASGYIEAEVIPAETGQETAYFILKLAGRWPVKTIHTDNGSNFTSATVKAACWWAGIKQEFGIPYNPQSQGVVESMNKELKKIIGQVRDQAEHLKTAVQMAVFIHNFKRKGGIGEYSAGERIIDIIATDIQTRELQKQITKIQNFRVYYRDSRDPLWKGPAKLLWKGEGAVVIQDNSDIKVVPRRKAKIIRDYGKQMAGDDCVAGRQDED

SEQ ID NO: 131 - protein, 1003 aa, Human immunodeficiency virus 1
FFRENLAFPQGEAREFSSEQNRANSPTRRELQVWGGDNNSLSEAGADRQGTVSLSFPQITLWQRPLVTIRIGGQLKEALLDTGADDTVLEEMSLPGRWKPKMIGGIGGFIKVRQYDQILIEICGHKAIGTVLIGPTPVNIIGRNLLTQLGCTLNFPISPIDTVPVKLKPGMDGPKVKQWPLTEEKIKALVEICTEMEKEGKISKIGPENPYNTPIFAIKKKDSTKWRKLVDFRELNRRTQDFWEVQLGIPHPSGLKKKKSVTVLDVGDAYFSVPLDKDFRKYTAFTIPSINNETPGVRYQYNVLPQGWKGSPAIFQSSMTKILEPFRKQNPDMVIYQYMDDLYVGSDLEIGQHRTKIEELRQHLLRWGLTTPDKKHQKEPPFLWMGYELHPDKWTVQPIKLPEKDSWTVNDIQKLVGKLNWASQIYAGIKVRQLCKLLRGAKALTEVIPLTAEAELELAENREILREPVHGVYYDPSKDLIAEIQKQGQGQWTYQIYQDPFKNLKTGKYAKMRGAHTNDVKQLTEAVQKVATESIVIWGKTPKFRLPIQKETWEAWWTEYWQATWIPEWEFVNTPPLVKLWYQLEKEPIEGAETFYVDGAANRDTKLGKAGYVTDRGRQKVVSLTDTTNQKTELQAIHLALQDSGLEVNIVTDSQYALGIIQAQPDKSESELVSQIIEELIKKEKVYLAWVPAHKGIGGNEQIDKLVSAGIRRVLFLDGIDQAQEEHEKYHSNWRAMASDFNLPPIVAKEIVASCDKCQLKGEAIHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIEQVRDQAEHLKTAVQMAVFIHNFKRKGGIGEYSAGERIIDIIATDIQTRELQKQITKIQNFRVYYRDNRDPLWKGPAKLLWKGEGAVVIQDNSDIKVVPRRKAKIIRDYGKQMAGDDCVAGRQDED

SEQ ID NO: 132 - protein, 1003 aa, Human immunodeficiency virus 1
FFRENLAFPQGKAREFPSEQTRANSPTSRELQVWGRDNNSLSEAGDDRQGTVSFSFPQITLWQRPLVTVKIGGQLKEALLDTGADDTVLEEMNLPGRWKPKMIGGIGGFIKVRQYDQIPIEICGHKAVGTVLVGPTPVNIIGRDLLTQIGCTLNFPISPIETVPVKLKPGMDGPKVKQWPLTEEKIKALIEICTELENEGKISKIGPENPYNTPVFAIKKKDGTKWRKLVDFRELNKRTQDFWEVQLGIPHPAGLKQKKSVTVLDVGDAYFSVPLDKEFRKYTAFTIPSTNNETPGIRYQYNVLPQGWKGSPAIFQCSMTKILEPFRKQNPDLVIYQYMDDLYVGSDLEIEQHRTKIEELREHLLKWGFTTPDKKHQNEPPFLWMGYELHPDKWTVQPIMLPEKDSWTVNDIQKLVGKLNWASQIYAGIKVKQLCKLLRGTKALTEVVPLTEEAELELAENREILKVPVHGVYYDPSKDLVAEIQKQGLGQWTYQIYQEPFKNLKTGKYARTRGAHTNDVRQLTEAVQKIATESIVIWGKTPKFKLPIQKETWEAWWMEYWQATWIPEWEFVNTPPLVKLWYQLEKEPIVGAETFYVDGAANRETKLGKAGYVTDKGRQKVVPLTDTTNQKTELQAINLALQDSGSEVNIVTDSQYAIGIIQAQPDRSESELVSQIIEQLINKEKVYLAWVPAHKGIGGNEQVDKLVSSGIRKVLFLDGIDKAQEDHEKYHSNWRAMAGDFNLPPVVAKEIVACCDKCQLKGEAMHGQVDCSPGIWQLDCTHLEGKVILVAVHVASGYIEAEVIPAETGQETAYFILKLAGRWPVKTVHTDNGSNFISTTVKAACWWAGVKQEFGIPYNPQSQGVVESMNNELKKIIGQVRDQAEHLKTAVQMAVFVHNFKRKGGIGGYTAGERIVDIIASDIQTKELQKQITKIQNFRVYYRDSRDPIWKGPAKLLWKGEGAVVIQDNSEIKVVPRRKAKIIRDYGKQMAGDDCVASRQNED

SEQ ID NO: 133 - protein, 1003 aa, Human immunodeficiency virus 1
FFREDLAFLQGKAREFSSEQTRANSPTRRELQVWGRDNNSPSEAGADRQGTVSFNFPQITLWQRPIVTIKIGGQLKEALLDTGADDTVLEDMNLPGKWKPKMIGGIGGFIKVRQYDQILVEICGHKAIGTVLVGPTPANIIGRNLLTQIGCTLNFPISPIETVPVKLKSGMDGPKVKQWPLTEEKIKALIEICTEMEKEGKISKIGPENPYNTPVFAIKKKDSTKWRKLVDFRELNKRTQDFWEVQLGIPHPSGLKKKKSVTVLDVGDAYFSVPLDEDFRKYTAFTIPSVNNETPGIRYQYNVLPQGWKGSPAIFQSSMTRILEPFRKQNPDIVIYQYMDDLYVGSDLEIGQHRAKIEELRQHLLRWGFTTPDKKHQKEPPFLWMGYELHPDKWTVQPIELPEKDSWTVNDIQKLVGKLNWASQIYPGIKVRQLCKLLRGTKALTEVIPLTEEAELELAENREILKEPVHGVYYDPSKELIAEIQKQEQGQWTYQIYQEPFKNLKTGKYARMRGTHTNDVKQLTEAVQKITTESIVIWGRTPKFKLPIQKETWESWWTEYWQATWIPEWEFVNTPPLVKLWYQLEREPIAGAETFYVDGASNRETKLGKAGYVTNRGRQKVVSLPDTTNQKTELQAIYLALQDSGLEVNIVTDSQYAIGIIQAQPDKSESELVNQIIEQLIKKEKIYLAWVPAHKGIGGNEQVDKLVSNGIRKILFLDGIDKAQDEHEKYHSNWKAMASDFNLPPVVAKEIVACCDKCQLKGEAMHGQVDCSPGIWQLDCTHLEGKIILVAVHVASGYIEAEVIPAETGQETAYFLLKLAGRWPVKIIHTDNGSNFTSTAVKAACWWAGIKQEFGIPYNPQSQGVVESINKELKKIIKQVRDQAEHLKTAVQMAVFIHNFKRKGGIGGYSAGERMIDIIATDIQTTELQKQITKLQNFRVYFRDSRDPLWKGPAKLLWKGEGAVVIQDNNDIKVVPRRKVKIIRDYGKQMAGDDCVASGQDED

SEQ ID NO: 134 - protein, 1003 aa, Human immunodeficiency virus 1
FFREDLAFPQGKARELSSEQTRANSPTRGELQVWGRDSNSLSEAGADRPGTVSFSFPQITLWQRPLVTIKIGGQQKEALLDTGADDTVLEEINLPGRWKPKIIGGIGGFIKVKQYDQIPIEICGHKVIGTVLVGPTPANIIGRNLLTQLGCTLNFPISPIETVPVRLKPGMDGPKVKQWPLTEEKIKALVEICTELEKEGKISKIGPENPYNTPVFAIKKKDSTKWRKVVDFRELNKKTQDFWEVQLGIPHPAGLKKKKSVTVLDVGDAYFSVPLDENFRKYTAFTIPSINNETPGIRYQYNVLPQGWKGSPSIFQSSMTKILEPFRKQNPEIVIYQYMDDLYVGSDLELGQHRTKIEELRQHLLKWGFYTPDKKHQKEPPFLWMGYELHPDKWTVQPIVLPEKDSWTVNDIQKLVGKLNWASQIYPGIKVKQLCRLLRGAKALTEVIPLTKEAELELAENREILKEPVHGAYYDPTKDLIAEIQKQGEGQWTYQIYQEPYKNLKTGKYARMRGAHTNDVKQLTETVQKITTESIVIWGKIPKFKLPIQKETWETWWTEYWQATWIPEWEFVNTPPLVKLWYQLEKEPIIGAETFYVDGAASRETKLGKAGYVTNKGRQKVVSITDTTNQKTELQAILLALQDSGLEVNIVTDSQYAIGIIQAQPDKSESEIVSQIIEQLIKKEKVYLTWVPAHKGIGGNEQVDKLVSAGIRKVLFLDGIDKAQEEHEKYHNNWRAMASDFNIPPVVAKEIVASCDKCQLKGEAMHGQVDCSPGIWQLDCTHLEGKVILVAVHVASGYIEAEIIPTETGQETAYFILKLAGRWPVTTIHTDNGSNFTSATVKAACWWAGVKQEFGIPYNPQSQGVIESMNKELKKIIGQIRDQAEHLKTAVQMAVFIHNFKRKGGIGGYSAGERIVDIIATDIQTKELQNQITKIQNFRVYYRDSRDPLWKGPAKLLWKGEGAVVIQENSDIKVVPRRKVKIIRDYGKQMAGDDCVASRQDED

SEQ ID NO: 135 - protein, 1003 aa, Human immunodeficiency virus 1
FFREDLAFPQGEAREFCSEQTRANSPATRELQVWGRDNTSLSEAGADRPGTVSFSFPQITLWQRPIVTVKIEGQLKEALLDTGADDTVLEEMNLPGKWKPKMIGGIGGFIKVRQYDQVSIEICGHKAIGTVLVGPTPANIIGRNLLTQIGCTLNFPISPIETVPVKLKPGMDGPKVKQWPLTEEKIKALVEICTELEKEGKISKIGPENPYNTPVFAIKKKDSTKWRKVVDFRELNKRTQDFWEVQLGIPHPSGLKKKKSVTVLDVGDAYFSVPLDENFRKYTAFTIPSINNETPGIRYQYNVLPQGWKGSPAIFQSSMTKILEPFRKQNPDIIIYQYMDDLYVGSDLEIGQHRAKIEELRQHLLKWGFTTPDKKHQKEPPFLWMGYELHPDKWTVQPIELPEKDSWTVNDIQKLVGKLNWASQIYAGIKVKELCKLLRGTKALTEVVPLTEEAELELAENREILKEPVHGVYYDPSKDLIAELQKQGQGQWTYQIYQEPYKNLKTGKYARTRGAHTNDVRQLTEAVQKIATEGIVIWGKTPKFKLPIQKETWEAWWTEYWQATWIPEWEFVNTPPLVKLWYQLEKEPILGAETFYVDGASNRETKLGKAGYVTDRGRQKVVSLTDTTNQKTELQAINLALQDSGLEVNIVTDSQYALGIIQAQPDRSESELVSQIIEQLINKEKVYLAWVPAHKGIGGNEQVDKLVSTGIRRVLFLDGIDKAQEEHEKYHSNWRAMASDFNLPPIVAKEIVASCDKCQLKGEAIHGQVDCSPGIWQLDCTHLEGKVILVAVHVASGYIEAEVIPAETGQETAYFILKLAGRWPVKTIHTDNGSNFTSTTVKAACWWAGIKQEFGIPYNPQSQGVVESMNKELKKIIEQVRDQAEHLKTAVQMAVFVHNFKRKGGIGEYSAGERIVDIIATDIQTKELQKHITKIQNFRVYYRDSRDPLWKGPAKLLWKGEGAVVIQDNSEIKVVPRRKAKIIRDYGKQMAGDDCVASRQDED

SEQ ID NO: 136 - protein, 1006 aa, Human immunodeficiency virus 1
FFREDLAFPQGKARELSSEQTRANSPTSPTRGELQVWGRDSNSLSEAGADRQGPVSFSFPQITLWQRPIVTIKIGGQLKEALLDTGADDTVLEDMNLPGRWKPKMIGGIGGFIKVKQYDEILVEICGHKAIGTVLIGPTPVNIIGRNLLTQLGCTLNFPISPIETVPVKLKSGMDGPKVKQWPLTEEKIKALVEICTELEKEGKISKIGPENPYNTPIFAIKKKDSTKWRKLVDFRELNKRTQDFWEVQLGIPHPAGLKKKKSVTVLDVGDAYFSVPLDKDFRKYTAFTIPSVNNETPGIRYQYNVLPQGWKGSPAIFQCSMTKILEPFRKQNPDMVIYQYMDDLYVGSDLEIGQHRIKIEELREHLLKWGFTTPDKKHQNEPPFLWMGYELHPDKWTVQPIVLPEKDSWTVNDIQKLVGKLNWASQIYPGIKVRQLCKLLRGTKALTEVIPLTEEAELELAENREILREPVHGVYYDPTKDLIAEIQKQGQGQWTYQIYQEPFKNLKTGKYARMRGAHTNDVKQLTEAVQKITTESIVIWGKIPKFRLPIQKETWEAWWIEYWQATWIPEWEFVNTPPLVKLWYQLEREPIAGAETFYVDGAANRETKLGKAGYVTNRGRQKVVSITDTTNQKTELQAILLALQDSGLEVNIVTDSQYALGIIQAQPDKSESELVNQIIEQLIKKEKIYLAWVPAHKGIGGNEQIDKLVSAGIRKVLFLDGIDKAQDEHEKYHSNWRAMAGDFNLPPVVAKEIVACCDKCQLKGEAMHGQVDCSPGIWQLDCTHLEGKIILVAVHVASGYIEAEVIPAETGQETAYFLLKLAGRWPVTTIHTDNGSNFTSATVKAACWWAGVKQEFGIPYNPQSQGVIESMNKELKKIIGQVRDQAEHLKTAVQMAVFIHNFKRKGGIGEYSAGERIIDIIATDIQTKELQKQITKIQNFRVYYRDSRDPIWKGPAKLLWKGEGAVVIQDNSEIKVVPRRKAKIIRDYGKQMAGDDCVAGRQDED

SEQ ID NO: 137 - protein, 1003 aa, Human immunodeficiency virus 1
FFRENLAFPQGEAREFSSEQTRANSPTRGELQVWGRDSNSLSEAGDDRQGTVSFSFPQITLWQRPLVTIKIGGQQKEALLDTGADDTVLEEMNLPGRWKPKIIGGIGGFIKVTQYDQIPIEICGHKAVGTVLVGPTPVNIIGRDLLTQIGCTLNFPISPIETVPVKLKSGMDGPKVKQWPLTEEKIKALIEICTEMEKEGKISKIGPENPYNTPVFAIKKKDGTKWRKLVDFRELNKKTQDFWEVQLGIPHPAGLKQKKSVTVLDVGDAYFSVPLDREFRKYTAFTIPSLNNETPGIRYQYNVLPQGWKGSPSIFQSSMTKILEPFRKQNPDLVIYQYMDDLYVGSDLELGQHRTKIEELRQHLLKWGFYTPDKKHQKEPPFLWMGYELHPDKWTVQPIKLPEKDSWTVNDIQKLVGKLNWASQIYPGIKVKQLCRLLRGAKALTEVVPLTKEAELELAENREILKEPVHGAYYDPTKDLIAEVQKQELGQWTYQIYQEPFKNLKTGKYARMKGAHTNDVKQLTETVQKITTESIVIWGKTPKFRLPIQKETWESWWTEYWQATWIPEWEFVNTPPLVKLWYQLEKEPITGAETFYVDGAANRETKIGKAGYVTDKGRQKVVSLPDTTNQKTELQAIHLALQDSGSEVNIVTDSQYAIGIIQAQPDRSESEVVNQIIEQLIKKEKVYLAWVPAHKGIGGNEQVDKLVSNGIRKILFLDGIDKAQEEHERYHSNWKAMASDFNLPPVVAKEIVACCDKCQLKGEAIHGQVDCSPGIWQLDCTHLEGKVILVAVHVASGYIEAEVIPAETGQETAYFILKLAGRWPVKIIHTDNGSNFTSTAVKAACWWAGIKQEFGIPYNPQSQGVVESINKELKKIIKQVRDQAEHLKTAVQMAVFIHNFKRKGGIGGYSAGERIIDIIASDIQTKELQNQITKIQNFRVYYRDSRDPVWKGPAKLLWKGEGAVVIQDNSDIKVVPRRKAKIIRDYGKQMAGDDCVASRQNED

SEQ ID NO: 138 - protein, 1003 aa, Human immunodeficiency virus 1
FFRENLAFPQRKAREFSSEQTRANSPTRRELQVWGGDNNSLSEAGADRQGTVSLSFPQITLWQRPLVTIKVGGQLKEALLDTGADDTVLEEINLPGRWKPKMIGGIGGFIKVRQYDQILVEICGHKAIGTVLVGPTPVNIIGRNLLTQIGCTLNFPISPIETVPVKLKPGMDGPKVKQWPLTEEKIKALVEICTEMEKEGKISKIGPENPYNTPIFAIKKKDSTKWRKLVDFRELNRRTQDFWEVQLGIPHPAGLKKKKSVTVLDVGDAYFSVPLDEDFRKYTAFTIPSINNETPGVRYQYNVLPQGWKGSPAIFQASMTKILEPFRKQNPDIVIYQYMDDLYVGSDLEIGQHRIKIEELRQHLLRWGLTTPDKKHQKEPPFLWMGYELHPDKWTVQPIMLPEKDSWTVNDIQKLVGKLNWASQIYAGIKVRQLCKLLRGAKALTEVIPLTAEAELELAENREILKVPVHGVYYDPSKELIAEIQKQEQGQWTYQIYQDPFKNLKTGKYARMRGTHTNDVRQLTEAVQKITTESIVIWGKIPKFKLPIQKETWETWWTEYWQATWIPEWEFVNTPPLVKLWYQLEKEPIIGAETFYVDGAASRETKLGKAGYVTDRGRQKVISLTDTTNQKTELQAIHLALQDSGVEVNIVTDSQYALGIIQAQPDKSESEIVSQIIEQLIKKEKVYLTWVPAHKGIGGNEQVDKLVSTGIRKVLFLDGIDQAQEEHEKYHSNWRTMASDFNLPPIVAKEIVASCDKCQLKGEAMHGQVDCSPGIWQLDCTHLEGKVILVAVHVASGYIEAEVIPAETGQETAYFLLKLAGRWPVKTIHTDNGPNFISTTVKAACWWAGIKQEFGIPYNPQSQGVVESMNNELKKIIGQVREQAEHLKTAVQMAVFIHNFKRKGGIGGYSAGERMIDIIATDIQTTELQKQITKLQNFRVYFRDSRDPLWKGPAKLLWKGEGAVVIQENSDIKVVPRRKAKIIRDYGKQMAGDDCVAGRQDED

SEQ ID NO: 139 - protein, 1003 aa, Human immunodeficiency virus 1
FFRENLAFPQGKAREFPSEQTRANSPTSRELQVWGRDNNSLSEAGANRQGTVSFSFPQITLWQRPLVTVKIGGQLKEALLDTGADDTVLEDMDLPGRWKPKMIGGIGGFIKVRQYDQIPIEICGHKVIGTVLVGPTPANIIGRNLLTQIGCTLNFPISPIETVPVRLKPGMDGPKVKQWPLTEEKIKALVEICTELEKEGKISKIGPENPYNTPVFAIKKKDSTKWRKLVDFRELNKKTQDFWEVQLGIPHPSGLKKKKSVTVLDVGDAYFSVPLDKEFRKYTAFTIPSTNNETPGIRYQYNVLPQGWKGSPAIFQASMTKILEPFRKQNPEIVIYQYMDDLYVGSDLEIEQHRTKIEELRQHLLRWGFTTPDKKHQKEPPFLWMGYELHPDKWTVQPIVLPDKDSWTVNDIQKLVGKLNWASQIYPGIKIRQLCKLLRGAKALTEVIPLTKEAELELAENREILKEPVHGVYYDPSKDLIAEIQKQGEGQWTYQIYQEPFKNLKTGKYAKMRGAHTNDVKQLTEAVQKVATESIVIWGKTPKFKLPIQKETWEAWWMEYWQATWIPEWEFVNTPPLVKLWYQLEKEPIEGAETFYVDGAANRDTKLGKAGYVTNKGRQKVVTLTDTTNQKTELQAIHLALQDSGLEVNIVTDSQYALGIIQAQPDKSESEIVNQIIEQLIKKEKVYLAWVPAHKGIGGNEQVDKLVSSGIRKVLFLDGIDKAQEDHEKYHSNWRAMANDFNLPPVVAKEIVACCDKCQLKGEAMHGQVDCSPGIWQLDCTHLEGKVILVAVHVASGYIEAEVIPAETGQETAYFILKLAGRWPVKTVHTDNGSNFTSNTVKAACWWAGIKQEFGIPYNPQSQGVVESMNKQLKQIIGQVRDQAEHLKTAVQMAVFIHNFKRKGGIGGYTAGERIVDIIATDIQTRELQKQITKIQNFRVYYRDSREPLWKGPAKLLWKGEGAVVIQDNSDIKVVPRRKAKIIRDYGKQMAGDDCVASGQDED

SEQ ID NO: 140 - protein, 1003 aa, Human immunodeficiency virus 1
FFREDLAFLQGKAREFSSEQTRAISPTRRELQVWGRDNNSPSEAGADRQGTVSFNFPQITLWQRPLVTIRIGGQLKEALLDTGADDTVLEEMSLPGRWKPKMIGGIGGFIKVRQYDQILIEICGHKAVGTVLIGPTPVNIIGRNLLTQIGCTLNFPISPIDTVPVKLKPGMDGPKVKQWPLTEEKIKALIEICTELENEGKISKIGPENPYNTPIFAIKKKDSTKWRKLVDFRELNKRTQDFWEVQLGIPHPSGLKKKKSVTVLDVGDAYFSIPLDEDFRKYTAFTIPSINNETPGTRYQYNVLPQGWKGSPAIFQSSMTRILEPFRKQNPDIVIYQYVDDLYVGSDLEIGQHRTKIEELREHLLRWGFTTPDKKHQKEPPFLWMGYELHPDKWTVQPITLPEKDSWTVNDIQKLVGKLNWASQIYAGIKVKQLCKLLRGTKSLTEVVPLTAEAELELAENREILKEPVHGAYYDPSKDLVAEIQKQGLGQWTYQIYQEPFKNLKTGKYAKMRGTHTNDVKQLTEAVQKIATESIVIWGRTPKFKLPIQKETWDAWWTEYWQATWIPEWEFVNTPPLVKLWYQLEKEPIVGAETFYVDGAANRETRLGKAGYVTDRGRQKVVPLTDTTNQKTELQAIYLALQDSGLEVNIVTDSQYALGIIQAQPDKSESELVSQIIEELIKKEKVYLAWVPAHKGIGGNEQVDKLVSAGIRRVLFLDGIDKAQEEHEKYHNNWRAMASDFNIPPVVAKEIVASCDKCQLKGEAIHGQVDCSPGIWQLDCTHLEGKIILVAVHVASGYIEAEIIPTETGQETAYFLLKLAGRWPVKTIHTDNGRNFTSNSVKAACWWAGIKQEFGIPYNPQSQGVVESMNRELKKIIGQIRDQAEHLKTAVQMAVFIHNFKRKGGIGGYSAGERIVDIIASDIQTKELQKQITKIQNFRVYYRDNRDPLWKGPAKLLWKGEGAVVIQDNNDIKVVPRRKVKIIRDYGKQMAGDDCVASRQDED

SEQ ID NO: 141 - protein, 1007 aa, Human immunodeficiency virus 1
FFRENLAFPQGEAREFPSEQTRANSPTSRANSPTSRELQVRGDNPRSEAGAERQGTLNFPQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAMESIVIWGKTPKFRLPIQKETWETWWTDYWQATWIPEWEFVNTPPLVKLWYQLEKEPIAGAETFYVDGAANRETKIGKAGYVTDRGRQKIVSLTETTNQKTELQAIQLALQDSGSEVNIVTDSQYALGIIQAQPDKSESELVNQIIEQLIKKERVYLSWVPAHKGIGGNEQVDKLVSSGIRKVLFLDGIDKAQEEHEKYHSNWRAMASEFNLPPIVAKEIVASCDKCQLKGEAIHGQVDCSPGIWQLDCTHLEGKIILVAVHVASGYIEAEVIPAETGQETAYYILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKVKIIKDYGKQMAGADCVAGRQDEDQ

SEQ ID NO: 142 - protein, 1006 aa, Human immunodeficiency virus 1
FFRENLAFPQGEAREFPPEQTRANSPTRANSPTSRKLQVRGDNPCSEAGAERQGTFNFPQITLWQRPLVTIKVGGQVKEALLDTGADDTVLEEINLPGKWKPKMIGGIGGFIKVRQYDQIVIEICGKKAIGTVLIGPTPVNIIGRNMLTQLGCTLNFPISPIETVPVKLKPGMDGPKIKQWPLTEEKIKALTAICDEMEKEGKIEKIGPENPYNTPIFAIKKKDSTKWRKLVDFKELNKRTQDFWEVQLGIPHPAGLKKKRSVTVLDVGDAYFSVPLDESFRKYTAFTIPSINNETPGIRYQYNVLPQGWKGSPAIFQSSMTRILEPFRAKNPEIVIYQYMDDLYIGSDLEIGQHRAKVEELREHLLRWGFTTPDKKHQKEPPFLWMGYELHPDKWTVQPIQLPEKDSWTVNDIQRLVGKLNWASQIYPGIKVRQLCKLLRGTKALTDIVPLTEEAELELAENREILKEPVHGVYYDPSKDLIAEIQKQGDDQWTYQIYQESFKNLKTGKYAKMRSAHTNDVKQLTEAVQKIALESIVIWGKAPKFRLPIQKETWEIWWTDYWQATWIPDWEFVNTPPLVKLWYQLEKEPIAGAETFYVDGAANRETKIGKAGYVTDRGRQKVVTLTETTNQKTELQAIQLALQDSGLEVNIVTDSQYALGIIQAQPDKSESELVNQIIEELIKKERVYLSWVPAHKGIGENEQVDKLVSNGIRKVLFLDGIDKAQEEHEKYHSNWRAMANEFNLPPVVAKEIVASCDKCQLKGEAIHGQVDCSPGMWQLDCTHLEGKVILVAVHVASGYVEAEVIPAETGQETAYFILKLAGRWPVKIIHTDNGSNFTSNAVKAACWWAGIQQEFGIPYNPQSQGVVESMNKELKKIIGQVREQAEHLKTAVQMAVFIHNFKRRGGIGGYSAGERIIDIIASDIQTKELQKQITKIQNFRVYYRDSRDPVWKGPAKLLWKGEGAVVIQDNGDIKVVPRRKAKIIKDYGKQMAGDDCVAGRQDEDQ

SEQ ID NO: 143 - protein, 1013 aa, Human immunodeficiency virus 1
FFRENLAFQQGEAREFPSEQTRANSPTSRANSPTSRTNSPTSRELQVRGDNPRSEAGVERQGTLNFPQITLWQRPLVSIKVGGQIKEALLDTGADDTVLEDINLPGKWKPRMIGGIGGFIKVRQYDQIPIEICGKKAIGTVLVGPTPVNIIRRNMLTQLRCTLNFPISPIKTVPVKLKPGMDGPKVKQWPLTEEKIKALTEICEEMEKEGKITKIGPENPYNTPVFAIKKKDSTKWRKLVDFRELNKRTQDFWEVQLGIPHPSGLKKKKSVTVLDVEDAYFSVPLDEGFRKYTAFTIPSTNNETPGIRYQYNVLPQGWKGSPAIFQCSMTKILEPFRTQNPDIVIYQYMDDLYVGSDLEIGQHRAKIEELRAHLLKWGLTTPDKKHQKEPPFLWMGYELHPDKWTVQPIKLPEKDSWTVNDIQKIVGKLNWASQIYPGIKVKQLCKLLRGAKALTDIIPLTEEAELELAENREILKEPVHGAYYDPSKDLVAEIQKQGHDQWTYQIYQEPYKNLKTGKYAKMRTAHTNDVRQLTEAVQKIAQESIVIWGKTPKFRLPIQKETWETWWTDYWQATWIPEWEFINTPPLVKLWYQLEKEPIVGAETFYVDGAANRETKMGKAGYVTDKGRQKIVSLTETTNQKAELQAIQLALQDSGPEVNIVTDSQYALGIIQAQPDRSESELVNQIIEQLINKERIYLSWVPAHKGIGGNEQVDKLVSSGIRKVLFLDGIDKAQEDHEKYHNNWRAMASDFNLPPIVAREIVASCDKCQLKGEAMHGQVDCSPGVWQLDCTHLEGKIILVAVHVASGYMEAEVIPAETGQETAYYILKLAGRWPVKVIHTDNGSNFTSTAVKAACWWAGIKQEFGIPYNPQSQGVVEAMNKELKKIIEQVRDQAEHLKTAVQMAVLIHNFKRKGGIGGYSAGERIVDIIATDIQTRELQKQIIQIQNFRVYYRDSRDPIWKGPAKLLWKGEGAVVIQDNSDIKVVPRRKVKIIKDYGKQMAGADCVASRQDED

SEQ ID NO: 144 - protein, 1007 aa, Human immunodeficiency virus 1
FFRENLAFPQGKAREFPSEQARANSPTSRANSPTSRELQVRRDNPRSEAGAERQGTLNCPQITLWQRPLVSIKIGGQTREALLDTGADDTVLEEISLPGKWKPKMIGGIGGFIKVRQYDQILIEICGKKAIGSVLVGPTPVNIIGRNLLTQLGCTLNFPISPIETIPVKLKPGMDGPRVKQWPLTEEKIKALTAICEEMEKEGKISKIGPENPYNTPIFAIKKKDSTKWRKLVDFRELNKRTQDFWEIQLGIPHPAGLKKKKSVTVLDVGDAYFSVPLDEDFRKYTAFTIPSINNATPGIRYQYNVLPQGWKGSPSIFQSSMTKILEPFRAQNPEIVIYQYMDDLYVGSDLEIEQHRAKIEELREHLLKWGFTTPDKKHQKEPPFLWMGCELHPDKWTVQPIQLPEKESWTVNDIQKLVGKLNWASQIYAGIKVKQLCRLLRGAKALTDIVPLTAEAELELAENREILREPVHGVYYDPSKELIAEIQKQGQDQWTYQIYQEPFKNLKTGKYAKRRTAHTNDVKQLAEAVQKIAMESIVIWGKIPKFRLPIQKETWEAWWTDYWQATWIPEWEFVNTPPLVKLWYQLEKDPIAGVETFYVDGAANRETKLGKAGYVTDRGRQKIVSLSETTNQKTELHAIQLALQDSGSEVNIVTDSQYALRIIQAQPDKSESEIVNQIIEQLIKKERVYLAWVPAHKGIGENEQVDKLVSKGIRKVLFLDGIEKAQEEHERYHSNWRAMASEFNLPPIVAKEIVASCDKCQLKGEATHGQVDCSPGIWQLDCTHLEGKVIIVAVHVASGYIEAEVIPAETGQETAYFLLKLAGRWPVKTIHTDNGSNFTSAAVKAACWWAGIHQEFGIPYNPQSQGVVESMNKELKKIIGQVRDQAEHLKTAVLMAVFIHNFKRKGGIGDYSAGERIIDIIATDIQTKELQKQIIKIQNFRVYYRDNRDPIWKGPAKLLWKGEGAVVLQDNSDIKVIPRRKAKIIRDYGKQMAGADCVAGRQDENQ

SEQ ID NO: 145 - protein, 1007 aa, Human immunodeficiency virus 1
FFRENLAFPQGKAREFPSEQARANSPTSRANSPTSRELQVRRDNPRSEAGAERQGTLNLPQITLWQRPLVSIKVGGQIKEALLDTGADDTVLEDINLPGKWKPKMIGGIGGFIKVRQYDQIPIEICGKKAIGTVLVGPTPVNIIGRNMLTQLGCTLNFPISPIETIPVKLKPGMDGPKVKQWPLTEEKIKALTEICKEMEKEGKIEKIGPENPYNTPVFAIKKKDSTKWRKLVDFRELNKRTQDFWEVQLGIPHPSGLKKKKSVTVLDVEDAYFSVPLDENFRKYTAFTIPSVNNETPGIRYQYNVLPQGWKGSPAIFQCSMTKILEPFRTQNPEIVIYQYMDDLYVGSDLEIGQHRAKIEKLREHLLKWGFTTPDKKHQKEPPFLWMGYELHPDKWTVQPIKLPEKDSWTVNDIQRLVGKLNWASQIYAGIKVRQLCKLLRGAKALTDIVPLTKEAELELAENREILKEPVHGVYYDPSKELIAEIQKQGQDQWTYQIYQEPFKNLKTGKYAKRRTAHTNDVKQLAEAVQKITMESIVIWGRTPKFRLPIQKETWEAWWTDYWQATWIPEWEFVNTPPLVKLWYQLEKEPIAEAETFYVDGAANRETKMGKAGYVTDKGRQKIVSLTETTNQKTELHAIQLALQDSGPEVNIVTDSQYALGIIQAQPDKSESELVSQIIEQLINKERIYLSWVPAHKGIGGNEQVDKLVSKGIRKVLFLDGIDKAQEEHERYHSNWRAMANEFNLPPIVAREIVASCDKCQLKGEAIHGQVDCSPGVWQLDCTHLEGKIILVAVHVASGYVEAEVIPAETGQETAYFLLKLAGRWPVKTIHTDNGSNFTSAAVKAACWWAGVQQEFGIPYNPQSQGVVESMNKELKKIIGQIRDQAEHLKTAVQMAVFIHNFKRKGGIGDYSAGERIIDIIATDIQTRELQKQIIQIQNFRVYYRDSRDPVWKGPAKLLWKGEGAVVLQDNSDIKVVPRRKVKIIKDYGKQMAGADCVAGRQDENQ

SEQ ID NO: 146 - protein, 1006 aa, Human immunodeficiency virus 1
FFRENLAFPEGEAREFPSEQTRANSPTRANSPTSRKLQVRGDNPRSEAGVERQGTLNFPQITLWQRPLVSIKIGGQTREALLDTGADDTVLEEIKLPGNWKPKMIGGIGGFIKVRQYDQILIEICGKKAIGTVLIGPTPVNIIGRNLLTQLGCTLNFPISPIKTVPVKLKPGMDGPKVKQWPLSEEKIKALTEICEEMEKEGKISKIGPENPYNTPVFAIKKKDSTKWRKLVDFRELNKRTQDFWEIQLGIPHPAGLKKKKSVTVLDVGDAYFSVPLDEDFRKYTAFTIPSINNATPGIRYQYNVLPQGWKGSPSIFQSSMTKILEPFRAKNPEIVIYQYMDDLYVGSDLEIGQHRAKVEELREHLLKWGLTTPDKKHQKEPPFLWMGYELHPDKWTVQPIQLPDKDSWTVNDIQKLVGKLNWASQIYPGIKVKQLCKLLRGTKALTDIVPLTAEAELELAENREILREPVHGVYYDPSKDLVAEIQKQGNDQWTYQIYQEPYKNLKTGKYAKMRSAHTNDVKQLTEAVQKIALESIVIWGKAPKFRLPIQKETWEIWWTDYWQATWIPDWEFVNTPPLVKLWYQLEKDPIAGVETFYVDGAANRETKLGKAGYVTDRGRQKIVSLSETTNQKTELQAIQLALQDSGLEVNIVTDSQYALGIIQAQPDKSESELVNQIIEELIKKEKVYLSWVPAHKGIGENEQVDKLVSSGIRKVLFLDGIEKAQEEHEKYHNNWRAMASEFNLPPIVAKEIVASCDKCQLKGEATHGQVDCSPGMWQLDCTHLEGKIIIVAVHVASGYLEAEVIPAETGQDTAYYILKLAGRWPVKVIHTDNGTNFTSAAVKAACWWAGIQQEFGIPYNPQSQGVVESMNKELKKIIGQVREQAEHLKTAVLMAVFIHNFKRKGGIGEYSAGERIIDMIATDIQTKELQNQITKIQNFRVYYRDSRDPIWKGPAKLLWKGEGAVVIQDNGDIKVVPRRKVKIIRDYGKQMAGDDCVAGRQDEDQ

SEQ ID NO: 147 - protein, 1010 aa, Human immunodeficiency virus 1
FFRENLAFPQGEAREFPPEQTRANSPTSRTNSPTSRELQVRGDNPHSEAGAERQGTLQGTLNCPQITLWQRPLVSIRVGGQIKEALLDTGADDTVLEEISLPGKWKPKMIGGIGGFIKVRQYDQIVIEICGKKAIGSVLVGPTPVNIIRRNMLTQLRCTLNFPISSIETVPVKLKPGMDGPRVKQWPLTEEKIKALTAICEEMEKEGKITKIGPDNPYNTPVFAIKKKDSTKWRKLVDFKELNKRTQDFWEVQLGIPHPAGLKRKKSVTVLDVGDAYFSVPLDEGFRKYTAFTIPSTNNETPGIRYQYNVLPQGWKGSPAIFQSSMIKILEPFRAQNPDIVIYQYMDDLYIGSDLEIGQHRAKIEELRAHLLKWGFTTPDKKHQKEPPFLWMGCELHPDKWTVQPIQLPEKESWTVNDIQRLVGKLNWASQIYSGIKVRQLCKLLRGVKALTDIVPLTEEAELELAENREILKETVHGAYYDPSKDLIAEIQKQGHDQWTYQIYQEPFKNLKTGKYAKMRTAHTNDIKQLTEAVQKIAMESIVIWGKTPKFRLPIQKETWETWWTDYWQATWIPEWEFINTPPLVKLWYQLEKEPIVGAETFYVDGAANRDTKLGKAGYITDRGRQKVVTLTETTNQKAELQAIQLALQDSGSKVNIVTDSQYALGIIQAQPDRSESELVNQIIEQLIKKERVYLSWVPAHKGIGGNEQIDKLVSSGIRRVLFLDGIDKAQEDHEKYHSNWRAMASDFNLPPIVAKEIIASCDKCQLKGEAMHGQVDCSPGIWQLDCTHLEGKVIIVAVHVASGYIEAEVIPAETGQETAYYILKLAGRWPVKIIHTDNGSNFTSNAVKAACWWAGIHQEFGIPYNPQSQGVVEAMNKELKKIIGQVRDQAEHLKTAVLMAVFIHNFKRRGGIGGYSAGERIIDIIASDIQTKELQKQITKIQNFRVYYRDSRDPIWKGPAKLLWKGEGAVVIQDNSDIKVIPRRKAKIIKDYGKQMAGADCVAGGQDEN

SEQ ID NO: 148 - protein, 999 aa, Human immunodeficiency virus 1
FFRENLAFQQGEAREFPSEQTRAISPTSRELQVRGDNPCSEAGAERQGTFNFPQITLWQRPLVTIKVGGQVKEALLDTGADDTVLEEINLPGKWKPRMIGGIGGFIKVRQYEQILIEICGKRAIGTVLVGPTPINIIGRNMLTQIGCTLNFPISPIETVPVKLKPGMDGPKIKQWPLTEEKIKALTAICDEMEKEGKITKIGPENPYNTPIFAIKKKDSTKWRKLVDFRELNKRTQDFWEVQLGIPHPAGLKKKRSVTVLDVGDAYFSVPLDESFRKYTAFTIPSINNETPGIRYQYNVLPQGWKGSPAIFQSSMTRILEPFRAQNPEIVIYQYMDDLYVGSDLEIEQHRAKIEELREHLLRWGFTTPDKKHQKEPPFLWMGYELHPDKWTVQPIQLPEKDSWTVNDIQKIVGKLNWASQIYPGIKVRQLCRLLRGAKALTDIIPLTEEAELELAENREILKEPVHGAYYDPSKDLIAEIQKQGDDQWTYQIYQESFKNLKTGKYAKMRTAHTNDVRQLTEAVQKIAQESIVIWGKIPKFRLPIQKDTWETWWTDYWQATWIPDWEFVNTPPLVKLWYQLEKEPIAGAETFYVDGAANRETKIGKAGYVTDRGRQKVITLTETTNQKTELQAIHLALQDSGSEVNIVTDSQYALRIIQAQPDKSESEIVNQIIEQLINKERVYLSWVPAHKGIGGNEQVDKLVSNGIRKVLFLDGIDKAQEEHEKYHSNWRAMASEFNLPPVVAKEIVASCDKCQQKGEAIHGQVDCSPRIWQLDCTHLEGKVILVAVHVASGYMEAEVIPAETGQETAYFILKLAGRWPVKVIHTDNGSNFTSTAVKAACWWAGIKQEFGIPYNPQSQGVVESMNKELKKIIEQVRDQAEHLKTAVQMAVLIHNFKRKGGIGGYSAGERIVDIIATDIQTKELQKQIIKIQNFRVYYRDNRDPIWKGPAKLLWKGEGAVVIQDNSEIKVVPRRKAKIIRDYGKQMAGADCVASRQDED

SEQ ID NO: 149 - protein, 999 aa, Human immunodeficiency virus 1
FFRENLAFPQGKAREFPSEQTRAISPTSRELQVRGNNPRSEAGAERQGTLNLPQITLWQRPLVSIKIGGQTREALLDTGADDTVLEEIKLPGNWKPKMIGGIGGFIKVRQYDQILIEICGKRAIGTVLVGPTPVNIIGRNMLTQIGCTLNFPISSIETVPVKLKPGMDGPKVKQWPLTEEKIKALTEICEEMEKEGKITKIGPDNPYNTPVFAIKKKDSTKWRKLVDFKELNKRTQDFWEVQLGIPHPAGLKKNKSVTVLDVGDAYFSVPLDESFRKYTAFTIPSINNETPGIRYQYNVLPQGWKGSPAIFQSSMTRILEPFRAQNPDIVIYQYMDDLYVGSDLEIEQHRAKIEELREHLLRWGFTTPDKKHQKEPPFLWMGCELHPDKWTVQPIQLPEKDSWTVNDIQKLVGKLNWASQIYSGIKVRQLCKLLRGVKALTDIVPLTKEAELELAENREILREPVHGVYYDPAKDLIAEIQKQGQDQWTYQIYQEPFKNLKTGKYAKRRTAHTNDVKQLTEAVQKIATESIVIWGKIPKFRLPIQKDTWETWWTDYWQATWIPDWEFVNTPPLVKLWYQLEKEPIAEAETFYVDGAASRETKMGKAGYVTDRGRQKVITLTETTNQKTELQAIKLALQDSGSEVNVVTDSQYALGIIQAQPDKSESEIVNQIIEQLINKERVYLSWVPAHKGIGGNEQVDKLVSRGIRKVLFLDGIDKAQDEHEKYHSNWRAMASEFNLPPIVAREIVASCDKCQLKGEATHGQVDCSPGIWQLDCTHLEGKIILVAVHVASGYIEAEVIPTETGQETAYYILKLAGRWPVKIIHTDNGSNFTSSAVKAACWWAGIQQEFGIPYNPQSQGVVESMNKELKKIIGQVGDQAEHLKTAVQMAVFIHNFKRRGGIGGYSAGERIIDIIATDIQTRELQKQIIKIQNFQVYYRDSRDPIWKGPAKLLWKGEGAVVIQDNSEIKVVPRRKVKIIKDYGKQMAGADCMASRQDED

SEQ ID NO: 150 - protein, 1000 aa, Human immunodeficiency virus 1
FFRENLAFPQGEARELPSEQTRANGPTSRELQVRGDNPCSEAGAERQGTFNFPQITLWQRPLVTIKVGGQVKEALLDTGADDTVLEEINLPGKWKPKMIGGIGGFIKVRQYDQIPIEICGKRAIGTVLVGPTPINIIGRNMLTQLGCTLNFPISPIETVPVQLKPGMDGPRVKQWPLTEEKIKALTEICKEMEKEGKISKIGPENPYNTPIFAIKKKDSTKWRKLVDFRELNKRTQDFWEVQLGIPHPAGLKKKRSVTVLDVGDAYFSVPLDEDFRKYTAFTIPSINNETPGVRYQYNVLPQGWKGSPSIFQSSMTKILEPFRTQNPEIVIYQYMDDLYIGSDLEIGQHREKIEELREHLLKWGFTTPDKKHQKEPPFLWMGYELHPDKWTVQPIKLPEKDSWTVNDIQRLVGKLNWASQIYAGIKVRQLCKLLKGAKALTDIVTLTEEAELELAENREILKEPVYGVYYDPSKDLVAEIQKQGNDQWTYQIYQESFKNLKTGKYAKMRTAHTNDIKQLTEAVQKIAQESIVIWGKTPKFRLPIQKETWEAWWTDYWQATWIPDWEFVNTPPLVKLWYQLEKEPMAGVETFYVDGAANRETKIGKAGYVTDRGRQKVVTITETTNQKTELQAIYLALQDSGSKVNIVTDSQYALGIIQAQPDKSESELVSQIIEQLINKEKIYLSWVPAHKGIGGNEQVDKLVSSGIRKVLFLDGIDKAQEDHERYHSNWRAMASDFNLPPIVAKEIVASCDQCQLKGEAMHGQVDCSPGMWQLDCTHLEGKIIIVAVHVASGYIEAEVISAETGQETAYYILKLAGRWPVKVVHTDNGSNFTSAAVKAACWWAGVQQEFGIPYNPQSQGVVESMNKELKRIIGQVRDQAEHLKTAVQMAVFIHNFKRKGGIGGYSAGERIIDMIATDIQTKELQKQIIQIQNFRVYYRDSRDPIWKGPAKLLWKGEGAVVIQDKGDIKVVPRRKAKIIRDYGKQMAGADCMAGRQDEDQ

SEQ ID NO: 151 - protein, 1006 aa, Human immunodeficiency virus 1
FFREDLAFPQGEARKFPPEQTRANSPTSRANSPTSRKLQVRGDNPRSEAGVERQGTLNFPQITLWQRPLVSIKVGGQIREALLDTGADDTVLEEMSLPGKWKPKMIGGIGGFIKVKQYEQILIEICGKKAIGSVLVGPTPVNIIGRNLLTQLGCTLNFPISPIETVPVKLKPGMDGPKVKQWPLTEEKIKALTAICDEMEKEGKITKIGPENPYNTPVFAIKKKDSTKWRKLVDFKELNKRTQDFWEVQLGIPHPAGLKKKKSVTVLDVGDAYFSVPLDENFRKYTAFTIPSRNNETPGIRYQYNVLPQGWKGSPAIFQASMTKILEPFRAKNPEIVIYQYMDDLYVGSDLEIGQHRAKIEELRDHLLKWGFTTPDKKHQKEPPFLWMGYELHPDKWTVQPIELPEKDSWTVNDIQKLVGKLNWASQIYPGIQVKQLCKLLRGAKALTDVVPLTEEAELELAENREILKEPVHGAYYDPSKDLIAEIQKQGHDQWTYQIYQEPYKNLKTGKYAKRRAAHTNDVKQLTEAVQKIAMESIVIWGKTPKFRLPIQKETWETWWTEYWQATWIPEWEFVNTPPLVKLWYQLEKEPIAGAETFYVDGAANRETKMGKAGYITDRGRQKIISLTETTNQKTELHAIQLALQDSGSEANIVTDSQYALGIIQAQPDRSESELVNQIIEQLIKKERVYLAWVPAHKGIGENEQVDKLVSSGIRKILFLDGIDKAQEEHEKYHSNWKAMASEFNLPPVVAREIVASCDKCQLKGEAMHGQVDCSPRIWQLDCTHLERKVILVAVHVASGYMEAEVIPAETGQETAYFILKLAGRWPVKVIHTDNGSNFTSNAVKAACWWAGIHQEFGIPYNPQSQGVVESMNKELKKIIEQVRDQAEHLKTAVQMAVLIHNFKRKGGIGGYTAGERIIDIIATDIQTKELQNQITKIQNFRVYYRDNRDPIWKGPAKLLWKGEGAVVLQDNSDIKVVPRRKVKIIRDYGKQMAGADCVAGRQDED

SEQ ID NO: 152 - protein, 1003 aa, Human immunodeficiency virus 1
FFRKNLAFPQGEAREFPPEQTRANSPTSRELQVRGDNPLSEAGAERQGTLQGTLNCPQITLWQRPLVSIKVGGQIKEALLDTGADDTVLEEISLPGKWKPKMIGGIGGFIKVRQYDQIVIEICGKKAIGAVLVGPTPVNIIRRNMLTQLRCTLNFPISPIKTVPVKLKPGMDGPKVKQWPLSEEKIKALTAICEDMEKEGKITKIGPENPYNTPIFAIKKKDSTKWRKLVDFRELNKRTQDFWEVQLGIPHPSGLKKKKSVTVLDVEDAYFSVPLDEGFRKYTAFTIPSINNATPGIRYQYNVLPQGWKGSPAIFQSSMTKILEPFRTKNPDIVIYQYMDDLYVGSDLEIGQHRAKIEKLREHLLRWGLTTPDKKHQKEPPFLWMGYELHPDKWTVQPIQLPDKDSWTVNDIQKLVGKLNWASQIYAGIKVKQLCRLLRGAKALTDIIPLTEEAELELAENREILKEPVHGAYYDPSKDLIAEIQKQGQGQWTYQIYQEPYKNLKTGKYAKMRTAHTNDVKQLAEAVQKITMESIVIWGRTPKFRLPIQKETWETWWTDYWQATWIPEWEFINTPPLVKLWYQLEKEPIVGAETFYVDGAANRETKLGKAGYVTDKGRQKIVSLTETTNQKTELQAIHLALQDSGSEVNIVTDSQYALRIIQAQPDKSESELVNQIIEQLINKERIYLSWVPAHKGIGGNEQVDKLVSNGIRKVLFLDGIEKAQEEHERYHSNWRAMANEFNLPPIVAREIVASCDKCQIKGEAMHGQVDCSPGVWQLDCTHLEGKVILVAVHVASGYVEAEVIPAETGQEAAYFILKLAGRWPVKTIHTDNGSNFTSTAVKAACWWAGIKQEFGIPYNPQSQGVVESMNKELKKIIGQVRDQAEHLKTAVQMAVLIHNFKRKGGIGDYSAGERIIDIIATDMQTKELQKQIIKVQNFRVYYRDSRDPIWKGPAKLLWKGEGAVVIQDNGDIKVVPRRKVKIIKDYGRQMAGADCVASRQDED

SEQ ID NO: 153 - protein, 1000 aa, Human immunodeficiency virus 1
FFRENLAFPEGEAREFPSEQARANSPTSRELQVRRDNPRSEAGAEGQGTLNFPQITLWQRPLVSIRVGGQIKEALLDTGADDTVLEEINLPGRWKPKMIGGIGGFIKVRQYDQITIEICGKKAIGTVLVGPTPINIIGRNMLTQIGCTLNFPISPIETVPVKLKPGMDGPKIKQWPLTEEKIKALKAICEEMEKEGKIEKIGPENPYNTPVFAIKKKDSTKWRKLVDFRELNKRTQDFWEIQLGIPHPAGLKRKKSVTVLDVGDAYFSVPLYEDFRKYTAFTIPSVNNETPGIRYQYNVLPQGWKGSPAIFQCSMTKILEPFRAQNPEIVIYQYMDDLYVGSDLEIGQHRAKVEELREHLLKWGLTTPDKKHQKEPPFLWMGYELHPDKWTVQPIQLPEKESWTVNDIQKIVGKLNWASQIYPGIKVRQLCRLLRGAKALTDIVPLTAEAELELAENREILKEPVHGVYYDPSKELIAEIQKQGDDQWTYQIYQEPFKNLKTGKYAKMRSAHTNDVKQLTEAVQKIALESIVIWGKAPKFRLPIQKETWEIWWTDYWQATWIPEWEFINTPPLVKLWYQLEKEPIAGVETFYVDGAANRDTKIGKAGYVTDRGRQKIVSLSETTNQKTELQAIQLALQDSGLEVNIVTDSQYALGIIQAQPDNSESELVNQIIEELIKKERVYLSWVPAHKGIGGNEQVDKLVSKGIRKVLFLDGIDKAQEEHEKYHNNWRAMASDFNLPPVVAKEIVACCDKCQLKGEAIHGQVDCSPGIWQLDCTHLEGKVIIVAVHVASGYLEAEVIPAETGQETAYFLLKLAGRWPVKVIHTDNGPNFTSAAVKAACWWAGINQEFGIPYNPQSQGVVESMNKELKKIIGQVREQAEHLKTAVQMAVFIHNFKRKGGIGGYSAGERIVDIIATDIQTKELQNQIIKIQNFRVYYRDSRDPIWKGPAKLLWKGEGAVVIQENSDIKVVPRRKAKIIKDYGKQMAGDDCVAGRQDEDQ

SEQ ID NO: 154 - protein, 1012 aa, Human immunodeficiency virus 1
FFRENLAFQQGEAREFPSEQTRANSPTRANSPTSRTNSPTSRELQVRGDNPHSEAGAERQGSLNFPQITLWQRPLVTIKIGGQLKEALLDTGADDTVLEDINLPGKWKPRMIGGIGGFIKVRQYEQIPIEICGKKAIGTVLIGPTPVNIIGRNLLTQLGCTLNFPISPIETIPVKLKPGMDGPKVKQWPLTEEKIKALTAICEEMEKEGKITKIGPDNPYNTPVFAIKKKDSTKWRKLVDFRELNKRTQDFWEVQLGIPHPAGLKKKKSVTVLDVGDAYFSVPLDKDFRKYTAFTIPSTNNETPGIRYQYNVLPQGWKGSPAIFQSSMIKILEPFRAKNPELVIYQYMDDLYVGSDLEIMQHRAKIEELRAHLLKWGFTTPDKKHQKEPPFLWMGYELHPDKWTVQPIVLPEKDSWTVNDIQKLVGKLNWASQIYPGIKVKQLCKLLRGTKALTDIVPLTEEAELELAENREILKETVHGAYYDPSKDLIAEIQKQGYDQWTYQIYQEPFKNLKTGKYAKKRTAHTNDVRQLTEAVQKIAIESIVIWGKTPKFRLPIQKETWETWWADYWQATWIPEWEFVNTPPLVKLWYQLEKDPIAGAETFYVDGAANRETKKGKAGYVTDKGRQKVVTLTETTNQKAELQAIQLALQDSGPEVNIVTDSQYALRIIQAQPDKSESGLVNQIIEQLIKKEKVYLSWVPAHKGIGGNEQIDKLVSSGIRRVLFLDGIDKAQEDHEKYHSNWRAMAGEFNLPPVVAKEIVASCDKCQQKGEAIHGQVDCSPGIWQLDCTHLEGKIILVAVHVASGYIEAEVIPAETGQDTAYYILKLAGRWPVKVIHTDNGTNFTSAAVKAACWWASIQQEFGIPYNPQSQGVVEAMNKELKKIIGQIRDQAEHLKTAVLMAVFIHNFKRKGGIGEYSAGERIIDIIASDIQTKELQKQITKIQNFRVYYRDSRDPVWKGPAKLLWKGEGAVVIQDNSDIKVIPRRKAKIIRDYGKQMAGADCVAGGQDED

SEQ ID NO: 155 - protein, 1007 aa, Human immunodeficiency virus 1
FFRENLAFPQGEAREFPSEQTRANSPTSRANSPTSRELQVRGDNPRSEAGAERQGTLNFPQITLWQRPLVTIKIGGQLKEALLDTGADDTVLEDINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRKQNPDIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYAKMRTAHTNDVKQLTEAVQKIATESIVIWGKTPKFRLPIQKETWETWWTDYWQATWIPEWEFVNTPPLVKLWYQLEKEPIVGAETFYVDGAANRETKLGKAGYVTDRGRQKVVSLTETTNQKTELQAIQLALQDSGSEVNIVTDSQYALGIIQAQPDKSESELVNQIIEQLIKKEKVYLSWVPAHKGIGGNEQVDKLVSSGIRKVLFLDGIDKAQEEHEKYHSNWRAMASDFNLPPIVAKEIVASCDKCQLKGEAMHGQVDCSPGIWQLDCTHLEGKVILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDEDQ

SEQ ID NO: 156 - protein, 1007 aa, Human immunodeficiency virus 1
FFRENLAFPQGEAREFPSEQTRANSPTSRANSPTSRELQVRGDNPRSEAGAERQGTLNFPQITLWQRPLVSIKVGGQIKEALLDTGADDTVLEEINLPGKWKPKMIGGIGGFIKVRQYDQIPIEICGKRAIGTVLVGPTPINIIGRNMLTQLGCTLNFPISPIKTVPVKLKPGMDGPKVKQWPLTEEKIKALTAICEEMEKEGKITKIGPENPYNTPVFAIKKKDGTKWRKLVDFRELNKRTQDFWEVQLGIPHPSGLKKKKSVSVLDVGDAYFSVPLDESFRKYTAFTIPSINNETPGIRYCYNVLPQGWKGSPAIFQCSMTKILEPFRAQNPEIVIYQYMDDLYIGSDLEIGQHRAKIEELREHLLRWGFTTPDKKHQKEPPFLWMGCELHPDKWTVQPIQLPEKDSWTVNDIQKIVGKLNWASQIYPGIKVRQLCKLLRGAKALTDIVPLTEEAELELAENREILREPVHGVYYDPSKDLVAEIQKQGQDQWTYQIYQEPFKNLKTGKYAKMRTAHTNDVKQLTEAVQKIALESIVIWGKIPKFRLPIQKETWEAWWMEYWQATWIPEWEFINTPPLVKLWYQLEKEPIAGAETFYVDGAANRETKIGKAGYVTDRGRQKIVSLTETTNQKAELQAIQLALQDSGPEVNIVTDSQYALGIIQAHPDKSESELVNQIIEQLIKKERVYLSWVPAHKGIGENEQVDKLVSNGIRKILFLDGIDKAQEEHEKYHSNWRAMASEFNLPPIVAKEIVASCNKCQLKGEALHGQVDCSPGMWQLDCTHLEGKVILVAVHVASGYMEAEVIPAETGQETAYYILKLAGRWPVKVVHTDNGSNFTSTAVKAACWWAGIQQEFGIPYNPQSQGVIESMNKELKKIIGQIRDQAEHLKTAVQMAVFIHNFKRKGGIGEYSAGERIIDIIATDIQTRELQKQIIKIQNFRVYYRDSRDPIWKGPAKLLWKGEGAVVLQDNSDIKVVPRRKVKIIKDYGKQMAGADCVAGRQDENQ

SEQ ID NO: 157 - protein, 1004 aa, Human immunodeficiency virus 1
FFRENLAFQQGEARKFSSEQTGANSPTSRELRVRRGDNPLSEAGAERRGTVPSLSFPQITLWQRPLVTVKIGGQLIEALLDTGADDTVLEDINLPGKWKPRMIGGIGGFIKVKQYDQILIEICGKKAIGTVLVGPTPVNIIGRNMLTQIGCTLNFPISPIDTVPVTLKPGMDGPKIKQWPLTEEKIKALTEICTEMEKEGKISRIGPENPYNTPIFAIKKKDSTKWRKLVDFRELNKKTQDFWEVQLGIPHPAGLKKKRSVTVLDVGDAYFSVPLDKDFRKYTAFTIPSTNNETPGIRYQYNVLPQGWKGSPSIFQSSMTRILEPFRAKNPEIVIYQYMDDLYVGSDLEIEQHRTKIEELRQHLLRWGLTTPDKKHQKEPPFLWMGYELHPDRWTVQPIELPEKESWTVNDIQKLVGKLNWASQIYAGIKVKQLCKLLRGTKALTEVVPLTEEAELELEENREILKDPVHGAYYDPSKDLIAEIQKQGHDQWTYQIYQEQYKNLKTGKYARKRSAHTNDVRQLTEAVQKIATESIVIWGKTPKFRLPIQRETWETWWTDYWQATWIPEWEFVNTPPLVKLWYQLEKDPIAGVETFYVDGASNRETKKGKAGYVTDKGRQKVVSLTETTNQKTELHAIHLALQDSGSEVNIVTDSQYALGIIQAQPDRSESELVNQIIEELIKKEKVYLSWVPAHKGIGGNEQVDKLVSSGIRKVLFLDRIDKAQEEHERYHSNWRTMASDFNLPPIVAKEIVANCDKCQLKGEAMHGQVDCSPGIWQIDCTHLEGKVIIVAVHVASGYIEAEVIPAETGQETAYFLLKLAGRWPVKVIHTDNGSNFTSAAVKAACWWANVTQEFGIPYNPQSQGVVESMNKELKKIIGQVREQAEHLKTAVQMAVLIHNFKRKGGIGGYSAGERIIDIIASDIQTKELQKQIIKVQNFRVYYRDSRDPVWKGPAKLLWKGEGAVVIQDNSDIKVVPRRKVKIIRDYGKQMAGDDCVAGRQDEDQ

SEQ ID NO: 158 - protein, 1003 aa, Human immunodeficiency virus 1
FFREDLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQILIEICGHKAIGTVLIGPTPVNIIGRNLLTQIGCTLNFPISPIETVPVKLKPGMDGPRVKQWPLTEEKIKALVEICTEMEKEGKISKIGPENPYNTPVFAIKKKDSTRWRKLVDFRELNKRTQDFWEIQLGIPHPAGLKKKKSVTVLDVGDAYFSVPLDEGFRKYTAFTIPSVNNETPGVRYQYNVLPQGWKGSPAIFQSSMTKILEPFRKQNPDIVIYQYMDDLYVGSDLEIGQHRTKIEELREHLLKWGFTTPDKKHQNEPPFLWMGYELHPDKWTVQPIVLPEKDSWTVNDLQKLVGKLNWASQIYPGIKVKQLCRLLRGAKALTEVIPLTKEAELELAENREILKEPVHGVYYDPSKELIAEIQKQGQGQWTYQIYQEPYKNLKTGKYARMRGAHTNDVKQLTEVVQKIAMESIVIWGKTPKFKLPIQKETWETWWTEYWQATWIPDWEFVNTPPLVKLWYQLEKEPIVGAETFYVDGAANRETKLGKAGYVTDRGRQKVVSLTDTTNQKTELQAIHLALQDSGLEVNIVTDSQYAIGIIQAQPDKSESELVSQIIEQLIKKEKVYLAWVPAHKGIGGNEQVDKLVSAGIRKVLFLDGIDKAQEDHEKYHNNWRAMASDFNLPPVVAKEIVASCDKCQLKGEAIHGQVDCSPGIWQLDCTHLEGKIILVAVHVASGYLEAEVIPAETGQETAYFILKLAGRWPVKTIHTDNGSNFTSTTVKAACWWAGIKQEFGIPYNPQSQGVVESINKELKKIIGQVRDQAEHLKTAVLMAVFIHNFKRRGGIGGYSAGERIVDIIATDIQTKELQKQITKIQNFRVYYRDSRDPLWKGPAKLLWKGEGAVVIQDNSEIKVVPRRKAKIIRDYGKQMAGDDCVASRQDED

SEQ ID NO: 159 - protein, 1004 aa, Human immunodeficiency virus 1
FFRENLAFQQGEARKFSSEQTRANSPTRGELQVWGRDNNPLSEAGAERRGTVPSLSFPQITLWQRPLVTVKIGGQLIEALLDTGADDTVLEDINLPGKWKPKMIGGIGGFIKVKQYDQILIEICGKKAIGTVLVGPTPVNIIGRNMLTQIGCTLNFPISPIDTVPVTLKPGMDGPRIKQWPLTEEKIKALTEICKEMEEEGKISKIGPENPYNTPIFAIKKKNSTRWRKLVDFRELNKKTQDFWEVQLGIPHPAGLKRKKSVTVLDVEDAYFSVPLDESFRKYTAFTIPSINNETPGVRYQYNVLPQGWKGSPAIFQCSMTKILEPFRIKNPEMVIYQYMDDLYVGSDLEIGQHRIKIEELRAHLLSWGFTTPDKKHQKDPPFLWMGYELHPDRWTVQPIELPEKDSWTVNDIQKLVEKLNWASQIYSGIKVRQLCRLLRGAKALTDIVPLTEEAELELAENREILKEPVHGAYYDPSKDLVAEIQKQGQDQWTYQIYQEPFKNLKTGKYARKRSAHTNDVKQLTEVVQKIATESIVIWGKTPKFRLPIQRETWETWWTEYWQATWIPEWEFVNTPPLVKLWYQLEKDPIAGVETFYVDGAASRETKLGKAGYVTDRGRQKVVSLTETTNQKTELHAIHLALQDSGSEVNIVTDSQYVLGIIQAQPDRSESELVNQIIEELIKKEKVYLSWVPAHKGIGGNEQVDKLVSSGIRKVLFLNGIDKAQEEHERYHSNWRTMASDFNLPPIVAKEIVANCDKCQLKGEAMHGQVDCSPGVWQLDCTHLEGKVIIVAVHVASGYIEAEVIPAETGQEAAYFILKLAGRWPVKVVHTDNGSNFTSAAVKAACWWANVRQEFGIPYNPQSQGVVESMNNELKKIIGQIRDQAEHLKTAVLMAVFIHNFKRKGGIGEYSAGERIIDIIATDIQTRELQKQITKIQNFRVYFRDSRDPIWKGPAKLLWKGEGAVVIQDNSEIKVVPRRKVKIIRDYGKQMAGDDCVAGRQDEN

SEQ ID NO: 160 - protein, 1008 aa, Human immunodeficiency virus 1
FFRENLAFPQGEAREFPSEQARANSPTSRANSPTSRDLWDGGRDNLPSEAGAERQGTLNFPQITLWQRPLVTVRIGGQLREALLDTGADDTVLEDIDLPGKWKPKIIGGIGGFIKVRQYEQIPIEICGHKAIGTVLVGPTPINIIGRNMLTQLGCTLNFPISPIKTVPVKLKPGMDGPRVKQWPLTEEKIKALTAICEEMEKEGKITKIGPENPYNTPVFAIKKKDSTRWRKLVDFRELNRRTQDFWEVQLGIPHPAGLKKKRSVTVLDVGDAYFSVPLDEGFRKYTAFTIPSVNNETPGIRYQYNVLPQGWKGSPSIFQSSMTRILEPFRAKNPEIVIYQYIDDLYVRSDLEIGQHRAKIEELREHLLRWGFTTPDKKHQKEPPFLWMGCELHPDKWTVQPIQLPEKDSWTINDIQKLVGKLNWASQIYPGIKVRQLCKLLRGTKALTDIVTLTEEAELELAENREILKDPVHGVYYDPSKELIAEIQKQGDDQWTYQIYQEQYKNLKTGKYAKRRTAHTNDVRQLTEAVQKIALESIVIWGKIPKFRLPIQKETWEAWWMEYWQATWIPEWEYVNTPPLVKLWYQLEKEPIIGAETFYVDGAANRETKLGKAGYVTNRGRQKVVSLTDTTNQKTELQAIQLALQDSGSEVNVVTDSQYALGIIQAHPDKSESELVNQIIEQLIKKERVYLSWVPAHKGIGGNEQVDKLVSAGIRKVLFLDGIDKAQEDHERYHSNWRAMASDFNLPPVVAKEIVASCNKCQLKGEAIHGQVDCSPGIWQLDCTHLEGKIIIVAVHVASGYMEAEVIPAETGQETAYFILKLAGRWPVKIIHTDNGSNFTSATVKAACWWANVTQEFGIPYNPQSQGVVESINKELKKIIGQVRDQAEHLRTAVQMAVFIHNFKRRGGIGGYSAGERIVDIIATDIQTKELQKQITKIQKFRVYYRDSRDPLWKGPAKLLWKGEGAVVIQDNSDIKVIPRRKAKIIKDYGKQMAGADCVAGRQDEDQ

SEQ ID NO: 161 - protein, 1006 aa, Human immunodeficiency virus 1
FFRENLAFPQGKAREFPSEQTRANSPTSRANSPTSRELQVRGDNPRSEAGAERQGTFNFPQITLWQRPLVSIKVGGQIKEALLDTGADDTVLEEINLPGKWKPRMIGGIGGFIKVRQYDQILIEICGKRAIGTVLVGPTPANIIGRNLLTQLGCTLNFPISPIETVPVKLKPGMDGPKIKQWPLTEEKIKALTEICTEMEKEGKISKIGPENPYNTPIFAIKKKDSTKWRKLVDFKELNKRTQDFWEVQLGIPHPSGLKKKKSVTVLDVGDAYFSVPLDEDFRKYTAFTIPSTNNETPGIRYQYNVLPQGWKGSPAIFQASMTKILEPFRAQNPEIVIYQYMDDLYVGSDLEIEQHRAKVEELREHLLKWGFTTPDKKHQNEPPFLWMGYELHPDKWTVQPIKLPEKESWTVNDIQKLVGKLNWASQIYPGIKVKQLCRLLRGTKALTEVIPLTKEAELELAENREILREPVHGVYYDPTKDLIAEIQKQGHDQWTYQIYQEPHKNLKTGKYAKMRTAHTNDVKQLAEAVQKIAMESIVIWGKIPKFKLPIQKETWETWWTDYWQATWIPDWEFVNTPPLVKLWYQLEKEPIAGAETFYVDGAANRETKIGKAGYVTDRGRQKIVSLTETTNQKAELQAIQLALQDSGPEVNIVTDSQYALGIIQAQPDKSESEIVNQIIEKLIEKDKVYLSWVPAHKGIGGNEQIDKLVSNGIRKVLFLDGIEKAQEEHEKYHSNWRAMASEFNLPPIVAKEIVASCDKCQLKGEATHGQVDCSPGMWQLDCTHLEGKIILVAVHVASGYIEAEVIPTETGQETAYYILKLAGRWPVKVIHTDNGSNFTSTAVKAACWWAGIQQEFGIPYNPQGQGVVESMNKELKKIIGQVREQAEHLKTAVQMAVLIHNFKRKGGIGGYSAGERIIDIIASDIQTKELQKQIIKVQNFRVYYRDSRDPIWKGPAKLLWKGEGAVVLQDNSDIKVVPRRKVKIIKDYGKQMAGADCVASRQDEN

SEQ ID NO: 162 - protein, 1003 aa, Human immunodeficiency virus 1
FFREDLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQIPIEICGKKAIGTVLIGPTPVNIIGRNLLTQIGCTLNFPISPIETIPVKLKPGMDGPKVKQWPLTEEKIKALVEICTEMEKEGKISRIGPENPYNTPVFAIKKKDGTKWRKLVDFRELNKRTQDFWEIQLGIPHPAGLKKKKSVSVLDVGDAYFSVPLDKDFRKYTAFTIPSINNETPGIRYCYNVLPQGWKGSPAIFQSSMTKILEPFRKQNPDIVIYQYMDDLYIGSDLEIGQHRTKIEELRQHLLRWGLTTPDKKHQNEPPFLWMGYELHPDKWTVQPIVLPEKDSWTVNDLQKLVGKLNWASQIYAGIKVKQLCKLLRGAKALTEVVPLTEEAELELEENREILKEPVHGVYYDPSKDLIAEIQKQGQGQWTYQIYQEPYKNLKTGKYARMRGAHTNDVKQLTEAVQKIAQECIVIWGKTPKFKLPIQKETWETWWMDYWQATWIPEWEFINTPPLVKLWYQLEKEPIVGAETFYVDGASNRETKKGKAGYVTDKGRQKVVTLTETTNQKTELQAIHLALQDSGLEVNIVTDSQYAIGIIQAQPDKSESELVSQIIEQLIKKEKVYLAWVPAHKGIGGNEQVDKLVSNGIRKILFLDGIDKAQEEHEKYHNNWRAMASDFNIPPVVAKEIVACCDKCQLKGEALHGQVDCSPRIWQLDCTHLEGKVILVAVHVASGYLEAEVIPAETGQETAYFLLKLAGRWPVKTIHTDNGSNFTSTTVKAACWWAGIKQEFGIPYNPQSQGVIESMNKELKKIIEQVRDQAEHLKTAVQMAVFVHNFKRKGGIGDYSAGERIIDIISTDIQTRELQKQIIKIQNFRVYYRDSRDPVWKGPAKLLWKGEGAVVIQDNNEIKVVPRRKAKIIRDYGKQMAGDDCVASRQDED

SEQ ID NO: 163 - protein, 1003 aa, Human immunodeficiency virus 1
FFREDLAFPQGEARKFPSEQTRANSPTRGELQVWGRDNNSLSEAGDDRQGTVSFNLPQITLWQRPLVTVRIGGQLIEALLDTGADDTVLEDMNLPGKWKPKMIGGIGGFIKVRQYEQIPIEICGHKAIGTVLIGPTPVNIIGRNLLTQIGCTLNFPISPIDTVPVTLKPGMDGPKIKQWPLTEEKIKALTEICTEMEKEGKISRIGPENPYNTPVFAIKKKNSTRWRKLVDFRELNKRTQDFCEVQLGIPHPAGLKKKRSVTVLDVGDAYFSVPLDENFRKYTAFTIPSINNETPGVRYQYNVLPQGWKGSPAIFQASMTKILEPFRTKNPELVIYQYMDDLYVGSDLEIEQHRTKIEELRAHLLSWGFTTPDKKHQKEPPFLWMGYELHPDKWTVQPIELPEKDSWTVNDIQKIVGKLNWASQIYPGIKVRQLCRLLRGTKALTDIVPLTAEAELELAENREILREPVHGVYYDPSKELIAEIQKQGHDQWTYQIYQDPFKNLKTGKYARKRSAHTNDVRQLTEAVQKITTESIVIWGKTPKFRLPIQRETWEAWWMEYWQATWIPEWEFINTPPLVKLWYQLEKDPIVGAETFYVDGAASRETKLGKAGYVTNKGRQKVVSLNETTNQKTELHAIHLALQDSGSEANIVTDSQYALGIIQAQPDRSESEVVNQIIEELIKKEKVYLSWVPAHKGIGGNEQVDKLVSSGIRKVLFLDGIDKAQEDHERYHSNWRTMASDFNLPPIVAREIVASCDKCQQKGEAMHGQVDCGPGIWQLDCTHLERKVILVAVHVASGYIEAEVIPAETGQETAYFVLKLAGRWPVKVIHTDNGSNFTSAAVKAACWWANVTQEFGIPYNPQSQGVVESMNNELKKIIGQVREQAEHLKTAVLMAVFIHNFKRKRGIGGYSAGERIVDIIASDIQTKELQNQITKIQNFRVYFRDSRDPIWKGPAKLLWKGEGAVVIQDNNDIKVVPRRKVKIIRDYGKQMAGDDCVAGRQDEN

SEQ ID NO: 164 - protein, 1000 aa, Human immunodeficiency virus 1
FFREDLAFQQGEARKFSSEQTRANSPTSRELRVWGGDNTLSETGAERQGTLNFPQITLWQRPLVTIKVGGQIKEALLDTGADDTVLEDINLPGKWKPRMIGGIGGFIKVRQYDQIPIEICGKKAIGSVLVGPTPVNIIGRNMLTQLGCTLNFPISPIKTVPVKLKPGMDGPKVKQWPLSEEKIKALTAICDEMEKEGKITKIGPDNPYNTPVFAIKKKDGTKWRKLVDFKELNKRTQDFWEIQLGIPHPAGLKKKKSVSVLDVGDAYFSVPLDESFRKYTAFTIPSLNNETPGIRYCYNVLPQGWKGSPAIFQSSMTKILEPFRAQNPEIVIYQYIDDLYVRSDLEIGQHRAKIEELREHLLKWGLTTPDKKHQKEPPFLWMGYELHPDRWTVQPIQLPDKDSWTVNDLQKLVGKLNWASQIYPGIRVKQLCKLLKGAKALTDIVTLTEEAELELAENREILKNPVHGVYYDPAKDLIAEIQKQGNDQWTYQIYQEPHKNLKTGKYAKMRTAHTNDVKQLTEVVQKIAMESIVIWGKVPKFRLPIQKETWETWWTDYWQATWIPDWEFVNTPPLVKLWYQLEKEPIAGAETFYVDGAANRETKMGKAGYVTDRGRQKVVSLTETTNQKTELQAIQLALQDSGPEVNIVTDSQYAIGIIQAQPDKSESEIVNQIIEQLIKKERVYLSWVPAHKGIGENEQVDKLVSTGIRRVLFLDGIDKAQEEHERYHSNWRAMASEFNLPPIVAKEIVASCDQCQLKGEAMHGQVDCSPGVWQLDCTHLEGKIILVAVHVASGYMEAEVIPAETGQETAYFILKLAARWPVKVIHTDNGPNFTSATVKAACWWANITQEFGIPYNPQGQGVVESMNKELKKIIKQVRDQAEHLKTAVQMAVLIHNFKRKGGIGGYSAGERIIDIIASDIQTKELQKQIIKIQNFQVYYRDSRDPIWKGPAKLLWKGEGAVVLQDNSDIKVVPRRKVKIIKDYGKQMAGADCVAGGQDED

SEQ ID NO: 165 - protein, 1003 aa, Human immunodeficiency virus 1
FFRENLAFPQGKAREFPSEQTRAISPTSRELQVWGGDNNSLSEAGAERQGTVSFSFPQITLWQRPIVTIKIGGQLREALLDTGADDTVLEEMNLPGRWKPKMIGGIGGFIKVKQYDNILIEICGHKAVGTVLVGPTPANIIGRNLLTQLGCTLNFPISPIETVPVKLKPGIDGPKVKQWPLTEEKIKALVEICTEMEKEGKISKIGPENPYNTPIFAIKKKDSTRWRKLVDFRELNRRTQDFWEVQLGIPHPAGLKRKKSVTVLDVGDAYFSVPLDKEFRKYTAFTIPSINNETPGIRYQYNVLPQGWKGSPSIFQSSMTKILEPFRIKNPEMVIYQYMDDLYIGSDLEIGQHRIKIEELREHLLKWGFTTPDKKHQKEPPFLWMGCELHPDKWTVQPIMLPEKDSWTVNDIQKLVGKLNWASQIYAGIKVRQLCKLLRGTKALTEVVPLTEEAELELAENREILKEPVHGAYYDPSKDLIAEVQKQGQDQWTYQIYQEPFKNLKTGKYAKKRSAHTNDVKQLTEAVQKIALESIVIWGKAPKFRLPIQKETWEAWWTEYWQATWVPEWEFVNTPPLVKLWYQLETEPIAGAETYYVDGAANRETKLGKAGYVTNRGRQKVVSLTDTTNQKTELQAIHLALQDSGLEVNIVTDSQYALGIIHAQPDKSESELVNQIIEQLINKERIYLSWVPAHKGIGENEQVDKLVSKGIRKVLFLDGIEKAQEEHEKYHSNWKAMASEFNLPPVVAKEIVACCDKCQLKGEALHGQVDCSPGMWQLDCTHLEGKIIIVAVHVASGYIEAEVIPTETGQETAYFLLKLAGRWPVKTIHTDNGSNFTSTTVKAACWWAGIKQEFGIPYNPQSQGVVESINKELKKIIGQIRDQAEHLKTAVLMAVFIHNFKRKGGIGGYTAGERIVDIIATDIQTKELQKQITKVQNFRVYYRDSREPLWKGPAKLLWKGEGAVVIQDNNEIKVVPRRKAKILRDYGKQMAGADCVASRQDEN

SEQ ID NO: 166 - protein, 1004 aa, Human immunodeficiency virus 1
FFRENLAFQQGEAREFSSEQTRTNSPTSRELWDGGRDNLPSEAGAERRGTVPSLSFPQITLWQRPLVTVKIGGQLKEALLDTGADDTVLEEINLPGKWKPKLIGGIGGFIKVRQYDQILIEICGKKAIGTVLVGPTPINIIGRNMLTQIGCTLNFPISPIETIPVKLKPGMDGPRVKQWPLTEEKIKALIEICTEMEKEGKISRVGPENPYNTPIFAIKKKNSNRWRKLVDFRELNKRTQDFWEVQLGIPHPGGLKKKKSVTILDVGDAYFSVPLDEDFRKYTAFTIPSINNATPGIRYQYNVLPQGWKGSPAIFQCSMTKILEPFRKQNPEIIIYQYMDDLYVRSDLEIGQHRTKIEELRQHLLKWGFYTPDKKHQKEPPFLWMGYELHPDKWTVQPIKLPEKESWTVNDIQKLVEKLNWASQIYPGIKVKQLCRLLRGAKALTEVIPLTEEAELELEENREILKDPVHGVYYDPTKDLIAEIQKQGDDQWTYQIYQEPYKNLKTGKYAKRRTAHTNDVRQLTEVVQKVATESIVIWGKIPKFKLPIQKETWEIWWTDYWQATWIPEWEFVNTPHLVKLWYQLEKEPIIGAETFYVDGASNRETKKGKAGYVTDRGRQKIVSLTETTNQKAELQAIQLALQDSGSEVNIVTDSQYALGIIQAHPDKSESELVSQIIEQLIKKEKVYLAWVPAHKGIGGNEQIDKLVSNGIRKILFLDGIDKAQEEHEKYHNNWRAMASDFNLPPVVAKEIVASCNKCQLKGEAIHGQVDCSPRIWQLDCTHLEGKVIMVAVHVASGYVEAEVIPAETGQDTAYFILKLAGRWPVKVVHTDNGSNFTSAAFKAACWWANVQQEFGIPYNPQSQGVVEAMNKELKKIIEQVRDQAEHLKTAVQMAVFVHNFKRKGGIGDYSAGERIIDIIATDIQTRELQKQIIKIQNFRVYYRDNRDPIWKGPAKLLWKGEGAVVIQDNSDIKVIPRRKAKIIRDYGKQMAGDDCMAGRQDEDQ

SEQ ID NO: 167 - protein, 1004 aa, Human immunodeficiency virus 1
FFREDLAFLQGKAREFSSEQTRANSPTRRELQVWGRDSNSLSEAGADRQGTVSFNFPQITLWQRPLVTIKIGGQLKEALLDTGADDTVLEDIDLPGKWKPKIIGGIGGFIKVKQYDQILIEICGKRAIGTVLVGPTPVNIIGRNILTQIGCTLNFPISPIDTVPVKLKPGMDGPRIKQWPLTEEKIKALTEICKEMEEEGKISKIGPENPYNTPVFAIKKKDSTKWRKVVDFRELNKGTQDFWEVQLGIPHPAGLKQKKSVTVLDVEDAYFSVPLDKDFRKYTAFTIPSVNNETPGIRYQYNVLPQGWKGSPAIFQSSMTRILEPFRKQNPDIVIYQYMDDLYVGSDLEIGQHRTKVEELRQHLLRWGFTTPDKKHQKDPPFLWMGYELHPDKWTVQPIVLPEKDSWTINDIQKLVGKLNWASQIYSGIKVRQLCKCLRGTKALTEVIPLTKEAELELAENKEILKEPVHGVYYDPSKDLVAEIQKQGQGQWTYQIYQEQYKNLKTGKYARMRGAHTNDVKQLAEAVQKIATESIVIWGKIPKFRLPIQRETWETWWTEYWQATWIPEWEYVNTPPLVKLWYQLEKEPIVGAETFYVDGAANRDTKLGKAGYVTDRGRQKVVPLTDTTNQKTELQAINLALQDSGSKVNIVTDSQYVLGIIQAQPDRSESEIVNQIIEKLIEKDKVYLSWVPAHKGIGGNEQVDKLVSAGIRKVLFLDGIDKAQDEHEKYHSNWRAMASDFNLPPVIAKEIVASCDKCQLKGEATHGQVDCSPGIWQLDCTHLEGKVIIVAVHVASGYIEAEVISAETGQETAYYILKLAGRWPVKIIHTDNGSNFTSTAVKAACWWAGIQQEFGIPYSPQSQGVVESMNKQLKQIIGQVRDQAEQLKTAVQMAVFIHNFKRKGGIGEYSAGERIIDIISTDIQTRELQKQITKIQNFRVYYRDSRDPVWKGPAKLLWKGEGAVVIQDNSEIKVVPRRKAKIIRHYGKQMAGDDCVASRQDEDQ

SEQ ID NO: 168 - protein, 1011 aa, Human immunodeficiency virus 1
FFRENLAFPQGEAREFPSEQARANSPTSRANSPTSRELQVRGDNPRSEAGAERQGTLQGTLNCPQITLWQRPLVSIKVGGQVKEALLDTGADDTVLEEMSLPGKWKPKMVGGIGGFIKVRQYDQILVEICGHKAIGTVLVGPTPVNIIRRNMLTQLRCTLNFPISPIETVPVTLKPGMDGPKVRQWPLTEEKIKALTAICEEMEKEGKITKIGPENPYNTPVFAIRKKDSTKWRKLVDFRELNKKTQDFWEVQLGIPHPSGLKKKKSVTVLDVGDAYFSVPLDEGFRKYTAFTIPSTNNETPGIRYQYNVLPQGWKGSPAIFQSSMIKILEPFRAKNPEIVIYQYMDDLYVGSDLEIGQHRAKVEELREHLLRWGFTTPDKKHQNEPPFLWMGYELHPDKWTVQPIQLPEKDSWTVNDIQRLVGKLNWASQIYAGIKVKQLCKLLRGAKALTDIVPLTEEAELELAENREILKTPVHGVYYDPSKDLIAEIQKQGQDQWSYQIYQEPFKNLKTGKYARTRGAHTNDVRQLTEAVQKIAQECIVIWGKTPKFKLPIQKDTWETWWMDYWQATWIPKWEFVNTPPLVKLWYQLEKDPIAGVETFYVDGAANRETKIGKAGYVTDKGRQKVVTLTETTNQKTELHAIYLALQDSGSEVNVVTDSQYALGIIQAQPDRSESELVNQIIEKLIGKDKVYLSWVPAHKGIGENEQVDKLVSNGIRKVLFLDGIDKAQEDHEKYHSNWRAMANEFNLPPIVAKEIVANCDKCQLKGEAMHGQVDCSPGIWQIDCTHLEGKVILVAVHVASGYLEAEVIPAETGQEAAYFILKLAGRWPVKTVHTDNGSNFTSNAVKAACWWANVRQEFGIPYNPQSQGVIESMNKELKKIIGQVRDQAEHLRTAVQMAVFIHNFKRRGGIGGYSAGERMIDIIATDIQTTELQKQITKIQKFRVYYRDSRDPLWKGPAKLLWKGEGAVVIQENSDIKVVPRRKAKIIKDYGKQVAGADCVAGRQDEDQ

SEQ ID NO: 169 - protein, 207 aa, Human immunodeficiency virus 1
MAAKWSKSSIVGWPAVRERMRRAEPAADGVGAVSRDLEKHGAITSSNTAATNADCAWLEAQEEDSEVGFPVRPHVPLRPMTYKAAVDLSHFLKEQGGLEGLIYSQKRQDILDLWVYHTQGYFPDWQNYTPGPGIRYPLTFGWCFKLVPVDPREVEEANKGENNCLLHPMSQHGMDDPEKEVLMWKFDSRLAFHHMAREKHPEFYKDC

SEQ ID NO: 170 - protein, 206 aa, Human immunodeficiency virus 1
MAAKWSKRSIVGWPAIRERMRRTEPAAEGVGAASQDLDKYGALTSSNTAQTNPDCAWLEAQEEEEVGFPVRPQVPVRPMTYKGALDLSHFLKEKGGLDGLIYSRKRQEILDLWVYNTQGYFPDWQNYTPGPGVRYPLTFGWCYKLVPVDPEEVEKANEGENNSLLHPMSLHGMEDPEREVLKWKFDSRLALKHRARELHPEFYKDC

SEQ ID NO: 171 - protein, 206 aa, Human immunodeficiency virus 1
MAANWSKSSIVGWPEIRERIRRTDPAAEGVGAASRDLERHGAITSSNTATTNAACAWLEAQEDEEVGFPVRPQVPLRPMTFKGAFDLGFFLKEKGGLEGLIYSKKRQDILDLWVYNTQGFFPDWQNYTPGPGTRFPLTFGWCFELVPVDPKEVEEANEGENNCLLHPICQHGMDDEEREVLMWKFDSSLARRHLAREKHPEYYKDC

SEQ ID NO: 172 - protein, 207 aa, Human immunodeficiency virus 1
MASKWSKSSIVGWPQVRERIRQTPPAAEGVGAVSQDLDKHGAVTSSNTAANNADCAWLQAQEEEEEVGFPVKPQVPLRPMTYKGAFDLSFFLKEKGGLDGLIYSKKRQEILDLWVYHTQGFFPDWHNYTPGPGTRYPLCFGWCFKLVPMDPAEVEEATEGENNSLLHPICQHGMEDEDREVLVWRFDSSLARRHIARELHPEYYKDC

SEQ ID NO: 173 - protein, 494 aa, Human immunodeficiency virus 1
MAARASVLSGGELDRWEKIRLRPGGKKKYKLKHIVWASRELERFAVNPGLLETSEGCRQILGQLQPSLQTGSEELRSLYNTVAVLYCVHQRIDVKDTKEALEKIEEEQNKSQQKTQQAKAADGKVSQNYPIVQNAQGQMVHQAISPRTLNAWVKVIEEKGFSPEVIPMFSALAEGATPQDLNTMLNTIGGHQAAMQMLKDTINDEAAEWDRLHPVQAGPVAPGQIREPRGSDIAGTTSNLQEQIGWMTSNPPIPVGDIYKRWIIMGLNKIVRMYSPTSILDIRQGPKESFRDYVDRFFRTLRAEQASQEVKNWMTETLLVQNSNPDCKTILKALGPAATLEEMMTACQGVGGPGHKARVLAEAMSQVQQPNIMMQRGNFKGQKRIKCFNCGREGHLARNCRAPRKKGCWKCGREGHQMKDCTESKANFLGKIWPSNKGRPGNFLQSRPEPSAPPAESFGFGEEITPSQKQEQKDKELYPLASLKSLFGNDPLSQ

SEQ ID NO: 174 - protein, 499 aa, Human immunodeficiency virus 1
MAARASVLSGGKLDAWEKIRLRPGGKKKYRLKHLVWASRELDRFALNPSLLETAEGCKQIMKQLQPALKTGTEELKSLYNTVATLYCVHEKIDVRDTKEALDKIEEEQNKIQQKTQQAKEADGKVSQNYPIVQNIQGQMVHQPISPRTLNAWVKVVEEKAFSPEVIPMFTALSDGATPQDLNSMLNAVGGHQAAMQILKDTINEEAADWDRLHPVHAGPVAPGQMREPRGSDIAGTTSTLQEQIGWMTNNPPIPVGEIYKRWIILGLNKIVRMYSPVSILDIKQGPKESFRDYVDRFFKVLRAEQATQDVKNWMTDTLLIQNANPDCKSILRALGPGATLEEMMTACQGVGGPSHKARILAEAMSQVTNSATIMMQRGNFRNQRKTVKCFNCGKEGHLARNCKAPRKRGCWKCGKEGHQMKECTERQANFLGKIWPSSKGRPGNFPQSRPEPTAPPEESFRFGEETTTPSQKQEPIDKELYPLASLRSLFGNDPSSQAS

SEQ ID NO: 175 - protein, 502 aa, Human immunodeficiency virus 1
MAARASILRGGKLDKWEKIRLRPGGKKRYMLKHLIWASRELERFALNPGLLETAEGCQQIIEQLQSTLKTGSEELKSLFNTVATLYCVHQRIEVKDTKEALDKVEEEQNKSKKKAQQAAADTGNSSQVSQNYPIVQNLQGQMVHQALSPRTLNAWVKVIEEKAFSPEIIPMFTALSEGATPSDLNTMLNTVGGHQAAMQMLKDTINEEAAEWDRVHPVHAGPIPPGQMREPRGSDIAGTTSSLQEQIAWMTSNPPVPVGEIYKRWIVLGLNKIVRMYSPVSILDIRQGPKEPFRDYVDRFFKTLRAEQASQDVKNWMTETLLVQNANPDCKTILRALGPGASLEEMMTACQGVGGPSHKARVLAEAMSQTNSAILMQRSNFKGSKRIVKCFNCGKEGHIARNCRAPRKRGCWKCGQEGHQMKDCNERQANFLGKIWPSHKGRPGNFLQNRPEPTAPPEPTAPPAESFRFEETTPAPKQELKDREPLTSLKSLFGSDPLSQAS

SEQ ID NO: 176 - protein, 504 aa, Human immunodeficiency virus 1
MAARASVLRGEKLDKWERIRLRPGGKKHYMLKHLVWASRELEKFALNPGLLETSEGCKQIIKQLQPALQTGTEELRSLFNTVATLYCVHAGIEVRDTKEALDKIEEIQNKSKQKTQQAAAGTGSSSKVSQNYPIVQNLQGQMVHQPLSPRTLNAWVKVVEEKGFNPEVIPMFSALSEGATPQDLNMMLNIVGGHQAAMQMLKETINEEAAEWDRLHPVHAGPIAPGQMREPRGSDIAGSTSTLQEQIAWMTGNPPVPVGDIYKRWIILGLNKIVKMYSPTSILDIKQGPKEPFRDYVDRFYKTLRAEQATQEVKNWMTDTLLVQNANPDCKSILKALGTGATLEEMMSACQGVGGPAHKARVLAEAMSQANNTNIMMQRSNFKGPKRIIKCFNCGKEGHIAKNCRAPRKKGCWKCGKEGHQMKDCTERQANFLGRIWPSSKGRPGNFLQSRPEPTAPPAEPTAPPAESFKFEETTPAPKQEPKDREPLTSLRSLFGSDPLLQAS

SEQ ID NO: 177 - protein, 853 aa, Artificial Sequence
  Description of Artificial Sequnce: Synthetic polypeptide
MRVKGIRKNYQHLWRWGTMLLGMLMICSAAEQLWVTVYYGVPVWRDAETTLFCASDAKAYEREVHNVWATHACVPTDPNPQEIVLENVTEEFNMWKNNMVDQMHEDIISLWDESLKPCVKLTPLCVTLNCTDVNVTKTNSTSWGMMEKGEIKNCSFNMTTELRDKKQKVYALFYKLDIVPLEENDTISNSTYRLINCNTSAITQACPKVTFEPIPIHYCTPAGFAILKCNDKKFNGTGPCKNVSTVQCTHGIRPVVTTQLLLNGSLAEEEIIIRSENLTNNAKTIIVQLNESVVINCTRPNNNTRKSIRIGPGQTFYATGDIIGNIRQAHCNISREKWINTTRDVRKKLQEHFNKTIIFNSSSGGDLEITTHSFNCRGEFFYCNTSKLFNSVWGNSSNVTKVNGTKVKETITLPCKIKQIINMWQEVGRAMYAPPIAGNITCKSNITGLLLVRDGGNVTNNTEIFRPGGGNMKDNWRSELYKYKVVEIKPLGIAPTKAKRRVVEREKRAVGLGAVFLGFLGAAGSTMGAASMTLTVQARQLLSGIVQQQSNLLRAIEAQQHMLQLTVWGIKQLQARILAVERYLRDQQLLGIWGCSGKLICTTNVPWNSSWSNKSLDEIWNNMTWMQWEKEIDNYTSLIYTLIEESQNQQEKNEQDLLALDKWANLWNWFDISNWLWYIRIFIMIVGGLIGLRIVFAVLSIVNRVRKGYSPLSFQTLTPNPRGPDRLGRIEEEGGEQDKDRSIRLVNGFLALAWDDLRNLCLFSYHRLRDLLLIVTRIVELLGRRGWEALKYLWNLLQYWIQELKNSAVSLLNATAIAVAEGTDRVIEVVQRACRAILHIPRRIRQGLERALL

SEQ ID NO: 178 - protein, 849 aa, Artificial Sequence
  Description of Artificial Sequnce: Synthetic polypeptide
MRVKETQMNWPNLWKWGTLILGLVIICSASDNLWVTVYYGVPVWKEATTTLFCASDAKAYDTEVHNVWATYACVPTDPNPQEVVLGNVTENFNMWKNNMVEQMHEDIISLWDQSLKPCVRLTPLCVTLNCSNANTTNTNSTEEIKNCSFNITTSIRDKVQKEYALFYKLDVVPIDNDNTSYRLISCNTSVITQACPKVSFEPIPIHYCAPAGFAILKCKDKKFNGTGPCTNVSTVQCTHGIRPVVSTQLLLNGSLAEEEVVIRSENFTNNAKTIIVHLNKSVEINCTRPNNNTRKSIHIGPGRAFYATGEIIGDIRQAHCNISRAKWNNTLKQIVKKLKEQFNKTIIFNQSSGGDPEITTHSFNCGGEFFYCNTSGLFNSTWNSTATQESNNTELNGNITLPCRIKQIVNMWQEVGKAMYAPPIRGQIRCSSNITGLILTRDGGNNNSTNETFRPGGGDMRDNWRSELYKYKVVKIEPLGVAPTKAKRRVVQREKRAVGTIGAMFLGFLGAAGSTMGAASLTLTVQARLLLSGIVQQQNNLLRAIEAQQHLLQLTVWGIKQLQARVLAVERYLKDQQLLGIWGCSGKLICTTTVPWNTSWSNKSLNEIWDNMTWMEWEREIDNYTGLIYTLLEESQNQQEKNEQELLELDKWASLWNWFDITKWLWYIKIFIMIVGGLVGLRIVFTVLSIVNRVRQGYSPLSFQTHLPAPRGPDRPEGIEEEGGERDRDRSGRLVDGFLAIIWVDLRSLCLFSYHQLRDFILIAARTVELLGHSSLKGLRRGWEALKYWWNLLQYWSQELKNSAISLLNTTAIVVAEGTDRIIEVLQRAGRAILHIPTRIRQGLERLLL

SEQ ID NO: 179 - protein, 864 aa, Artificial Sequence
  Description of Artificial Sequnce: Synthetic polypeptide
MRVRGIQRNWPQWWIWGILGFWMLMICNVVGNLWVTVYYGVPVWKEAKTTLFCASDAKAYEKEVHNVWATHACVPTDPSPQEVVLENVTENFNMWKNDMVDQMHEDVISLWDQSLKPCVKLTHLCVTLNCTNATNTNYNNSTNVTSSMIGEMKNCSFNITTEIRDKSRKEYALFYRLDIVPLNEQNSSEYRLINCNTSTITQACPKVSFDPIPIHYCAPAGYAILKCNNKTFNGTGPCNNVSTVQCTHGIKPVVSTQLLLNGSLAEGEIIIRSENLTDNAKTIIVHLNESVEIVCTRPNNNTRKSVRIGPGQAFYATGDIIGDIRQAHCNLSRTQWNNTLKQIVTKLREQFGNKTIVFNQSSGGDPEIVMHSFNCGGEFFYCNTTQLFNSTWENSNITQPLTLNRTKGPNDTITLPCRIKQIINMWQGVGRAMYAPPIEGLIKCSSNITGLLLTRDGGNNSETKTTETFRPGGGNMRDNWRNELYKYKVVQIEPLGVAPTRAKRRVVEREKRAVGIGAVFLGFLGTAGSTMGAASITLTVQARQVLSGIVQQQSNLLKAIEAQQHLLKLTVWGIKQLQTRVLAIERYLKDQQLLGLWGCSGKLICTTAVPWNSSWSNKSQTDIWDNMTWMQWDREISNYTDTIYRLLEDSQNQQEKNEKDLLALDSWKNLWNWFDITNWLWYIKIFIIIVGGLIGLRIIFAVLSIVNRCRQGYSPLSLQTLIPNPRGPDRLGGIEEEGGEQDRDRSIRLVSGFLALAWDDLRSLCLFSYHRLRDFILIVARAVELLGRSSLRGLQRGWEALKYLGSLVQYWGLELKKSAISLLDTIAIAVAEGTDRIIEVIQRICRAIRNIPRRIRQGFEAALL

SEQ ID NO: 180 - DNA, 657 bp, Artificial Sequence
  Description of Artificial Sequnce: Synthetic polynucleotide
ctcgagaagaaaatggcggccaagtggtcgaagagctccatcgtcgggtggccggcggtccgggagcgcatccggcggacgcaccccgcggccgagggggtcggcgcggtctcgcaagacctcgacaagcacggggcgatcacgtcgagcaacaccgccgcgaacaaccccgactgcgcgtggctggaggcccaggaggaagaggaagaggtcggcttcccggtccgcccgcaagtgccgctcaggccgatgacgtacaaggcggccctcgacctctcgcacttcctgaaagagaagggtggcctggaggggctcatctactcgaagaagaggcaggagatcctcgacctgtgggtctaccacacccagggctacttcccggactggcagaactacacgccaggcccgggaatccgctacccgctgaccttcgggtggtgcttcaagctcgtccccgtcgacccggaggaggtcgaggaagccaacgagggcgagaacaacagcctcctgcacccgatgtgccagcacgggatggaggacgaggagcgcgaggtgctgatgtggaagttcgactcgcgcctggccctgcgccacatcgcccgggagctccacccggagtactacaaggactgctgataagctagcggatcctgatca

SEQ ID NO: 181 - protein, 207 aa, Artificial Sequence
  Description of Artificial Sequnce: Synthetic polypeptide
MAAKWSKSSIVGWPAVRERIRRTHPAAEGVGAVSQDLDKHGAITSSNTAANNPDCAWLEAQEEEEEVGFPVRPQVPLRPMTYKAALDLSHFLKEKGGLEGLIYSKKRQEILDLWVYHTQGYFPDWQNYTPGPGIRYPLTFGWCFKLVPVDPEEVEEANEGENNSLLHPMCQHGMEDEEREVLMWKFDSRLALRHIARELHPEYYKDC

SEQ ID NO: 182 - DNA, 3953 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgagaagaaaatggcggccaagtggtcgaagagctccatcgtcgggtggccggcggtccgggagcgcatccggcggacgcaccccgcggccgagggggtcggcgcggtctcgcaagacctcgacaagcacggggcgatcacgtcgagcaacaccgccgcgaacaaccccgactgcgcgtggctggaggcccaggaggaagaggaagaggtcggcttcccggtccgcccgcaagtgccgctcaggccgatgacgtacaaggcggccctcgacctctcgcacttcctgaaagagaagggtggcctggaggggctcatctactcgaagaagaggcaggagatcctcgacctgtgggtctaccacacccagggctacttcccggactggcagaactacacgccaggcccgggaatccgctacccgctgaccttcgggtggtgcttcaagctcgtccccgtcgacccggaggaggtcgaggaagccaacgagggcgagaacaacagcctcctgcacccgatgtgccagcacgggatggaggacgaggagcgcgaggtgctgatgtggaagttcgactcgcgcctggccctgcgccacatcgcccgggagctccacccggagtactacaaggactgctgataagctagcggatcctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 183 - DNA, 11 bp, Human immunodeficiency virus 1
  modified_base (4)..(8): a, c, t, g, unknown or other
gccnnnnnggc

SEQ ID NO: 184 - DNA, 10 bp, Human immunodeficiency virus 1
  modified_base (4)..(7): a, c, t, g, unknown or other
gaannnnttc

SEQ ID NO: 185 - DNA, 663 bp, Human immunodeficiency virus 1
ctcgagaagaaaatggcggccaagtggtcgaagagctccatcgtcgggtggccggcggtccgggagaggatgcggagggcggagccggcggccgacggggtcggggcggtctcgcgggacctggagaagcacggggcgatcacgtcgagcaacaccgccgcgacgaacgcggactgcgcgtggctggaggcccaggaggaggactcggaggtcggcttcccggtccggccgcacgtcccgctccggccgatgacgtacaaggcggccgtcgacctctcccacttcctgaaagagcaggggggcctggaggggctcatctactcgcagaagaggcaggacatcctcgacctgtgggtctaccacacccagggctacttcccggactggcagaactacacgccaggcccgggaatccgctacccgctgaccttcgggtggtgcttcaagctcgtccccgtggacccgcgggaggtcgaggaagccaacaagggggagaacaactgcctcctgcacccgatgtcgcagcacgggatggacgacccggagaaggaggtgctgatgtggaagttcgactcgcggctggcgttccaccacatggcccgcgagaagcacccggagttctacaaggactgctgataagctagctgatcaggatccacgcgt

SEQ ID NO: 186 - protein, 207 aa, Human immunodeficiency virus 1; identical to SEQ ID NO: 169

SEQ ID NO: 187 - DNA, 3918 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgagaagaaaatggcggccaagtggtcgaagagctccatcgtcgggtggccggcggtccgggagaggatgcggagggcggagccggcggccgacggggtcggggcggtctcgcgggacctggagaagcacggggcgatcacgtcgagcaacaccgccgcgacgaacgcggactgcgcgtggctggaggcccaggaggaggactcggaggtcggcttcccggtccggccgcacgtcccgctccggccgatgacgtacaaggcggccgtcgacctctcccacttcctgaaagagcaggggggcctggaggggctcatctactcgcagaagaggcaggacatcctcgacctgtgggtctaccacacccagggctacttcccggactggcagaactacacgccaggcccgggaatccgctacccgctgaccttcgggtggtgcttcaagctcgtccccgtggacccgcgggaggtcgaggaagccaacaagggggagaacaactgcctcctgcacccgatgtcgcagcacgggatggacgacccggagaaggaggtgctgatgtggaagttcgactcgcggctggcgttccaccacatggcccgcgagaagcacccggagttctacaaggactgctgataagctagctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 188 - DNA, 11 bp, Human immunodeficiency virus 1
  modified_base (4)..(8): a, c, t, g, unknown or other
ccannnnntgg

SEQ ID NO: 189 - DNA, 654 bp, Human immunodeficiency virus 1
ctcgagaagaaaatggcggccaagtggtcgaagcggtccatcgtcgggtggccggcgatccgggagaggatgcggaggacggagccggcggccgagggggtcggggcggcgtcgcaggacctcgacaaatacggggcgctcacgtcgagcaacaccgcccagacgaacccggactgcgcgtggctggaggcccaggaggaggaagaggtcggcttcccggtccggccgcaagtcccagtcaggccgatgacgtacaagggcgccctggacctctcccacttcctgaaagagaaggggggcctggacgggctcatctactcgcggaagaggcaggagatcctcgacctgtgggtctacaacacccagggctacttccccgactggcagaactacacgccaggccccggagtgcggtacccgctgaccttcgggtggtgctacaagctcgtccccgtggacccggaggaggtcgagaaggccaacgagggggagaacaactccctcctgcacccgatgtcgctccacgggatggaggaccccgagagggaggtgctgaagtggaagttcgactcgcggctggcgctcaagcaccgggcccgggagctccacccggagttctacaaggactgctgataagctagcggatcctgatca

SEQ ID NO: 190 - protein, 206 aa, Human immunodeficiency virus 1; identical to SEQ ID NO: 170

SEQ ID NO: 191 - DNA, 3950 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgagaagaaaatggcggccaagtggtcgaagcggtccatcgtcgggtggccggcgatccgggagaggatgcggaggacggagccggcggccgagggggtcggggcggcgtcgcaggacctcgacaaatacggggcgctcacgtcgagcaacaccgcccagacgaacccggactgcgcgtggctggaggcccaggaggaggaagaggtcggcttcccggtccggccgcaagtcccagtcaggccgatgacgtacaagggcgccctggacctctcccacttcctgaaagagaaggggggcctggacgggctcatctactcgcggaagaggcaggagatcctcgacctgtgggtctacaacacccagggctacttccccgactggcagaactacacgccaggccccggagtgcggtacccgctgaccttcgggtggtgctacaagctcgtccccgtggacccggaggaggtcgagaaggccaacgagggggagaacaactccctcctgcacccgatgtcgctccacgggatggaggaccccgagagggaggtgctgaagtggaagttcgactcgcggctggcgctcaagcaccgggcccgggagctccacccggagttctacaaggactgctgataagctagcggatcctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 192 - DNA, 654 bp, Human immunodeficiency virus 1
ctcgagaagaaaatggcggccaactggtcgaagagctccatcgtcgggtggccggagatccgggagcgcatccggaggacggacccggcggccgagggggtcggggcggcctcgcgggacctggagcgccacggggcgatcacgtcgagcaacaccgccaccacgaacgcggcctgcgcgtggctggaggcccaggaggacgaggaagtcggcttcccggtccggccgcaagtcccgctcaggccgatgacgttcaagggggccttcgacctcggcttcttcctgaaagagaaggggggcctggaggggctcatctactcgaagaagaggcaggacatcctcgacctgtgggtctacaacacccaggggttcttcccggactggcagaactacacgccaggcccgggaacccggttcccgctgaccttcgggtggtgcttcgagctcgtccccgtggacccgaaggaggtcgaggaagccaacgagggggagaacaactgcctcctgcacccgatctgccagcacgggatggacgacgaggagcgcgaggtgctgatgtggaagttcgactcgtccctggcccggcgccacctcgcccgggagaagcacccggagtactacaaggactgctgataagctagcggatcctgatca

SEQ ID NO: 193 - protein, 206 aa, Human immunodeficiency virus 1; identical to SEQ ID NO: 171

SEQ ID NO: 194 - DNA, 3950 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgagaagaaaatggcggccaactggtcgaagagctccatcgtcgggtggccggagatccgggagcgcatccggaggacggacccggcggccgagggggtcggggcggcctcgcgggacctggagcgccacggggcgatcacgtcgagcaacaccgccaccacgaacgcggcctgcgcgtggctggaggcccaggaggacgaggaagtcggcttcccggtccggccgcaagtcccgctcaggccgatgacgttcaagggggccttcgacctcggcttcttcctgaaagagaaggggggcctggaggggctcatctactcgaagaagaggcaggacatcctcgacctgtgggtctacaacacccaggggttcttcccggactggcagaactacacgccaggcccgggaacccggttcccgctgaccttcgggtggtgcttcgagctcgtccccgtggacccgaaggaggtcgaggaagccaacgagggggagaacaactgcctcctgcacccgatctgccagcacgggatggacgacgaggagcgcgaggtgctgatgtggaagttcgactcgtccctggcccggcgccacctcgcccgggagaagcacccggagtactacaaggactgctgataagctagcggatcctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 195 - DNA, 657 bp, Human immunodeficiency virus 1
ctcgagaagaaaatggcctccaagtggtcgaagagctccatcgtcgggtggccgcaagtccgggagcgcatccggcagacgccccccgcggccgagggggtcggcgcggtctcgcaggacctcgacaagcacggggcggtcacgtcgagcaacaccgccgcgaacaacgcggactgcgcgtggctgcaggcccaggaggaagaggaagaggtcggcttcccggtcaagccgcaagtgccgctcaggccgatgacgtacaagggggccttcgacctctcgttcttcctgaaagagaagggtggcctggacgggctcatctactcgaagaagaggcaggagatcctcgacctgtgggtctaccacacccaggggttcttcccggactggcacaactacacgccaggcccgggaacccgctacccgctgtgcttcgggtggtgcttcaagctcgtccccatggacccggccgaggtcgaggaagccaccgagggcgagaacaactccctcctgcacccgatctgccagcacgggatggaggacgaggaccgcgaggtgctggtctggcggttcgactcgtccctggcccggcgccacatcgcccgggagctccacccggagtactacaaggactgctgataagctagcggatcctgatca

SEQ ID NO: 196 - protein, 207 aa, Human immunodeficiency virus 1; identical to SEQ ID NO: 172

SEQ ID NO: 197 - DNA, 3953 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgagaagaaaatggcctccaagtggtcgaagagctccatcgtcgggtggccgcaagtccgggagcgcatccggcagacgccccccgcggccgagggggtcggcgcggtctcgcaggacctcgacaagcacggggcggtcacgtcgagcaacaccgccgcgaacaacgcggactgcgcgtggctgcaggcccaggaggaagaggaagaggtcggcttcccggtcaagccgcaagtgccgctcaggccgatgacgtacaagggggccttcgacctctcgttcttcctgaaagagaagggtggcctggacgggctcatctactcgaagaagaggcaggagatcctcgacctgtgggtctaccacacccaggggttcttcccggactggcacaactacacgccaggcccgggaacccgctacccgctgtgcttcgggtggtgcttcaagctcgtccccatggacccggccgaggtcgaggaagccaccgagggcgagaacaactccctcctgcacccgatctgccagcacgggatggaggacgaggaccgcgaggtgctggtctggcggttcgactcgtccctggcccggcgccacatcgcccgggagctccacccggagtactacaaggactgctgataagctagcggatcctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 198 - protein, 497 aa, Artificial Sequence
  Description of Artificial Sequnce: Synthetic polypeptide
MAARASVLSGGKLDAWEKIRLRPGGKKKYRLKHLVWASRELERFALNPGLLETSEGCQQIIGQLQPALQTGSEELRSLYNTVATLYCVHQRIEVKDTKEALEKIEEEQNKSQQKTQQAAADKGNSSKVSQNYPIVQNLQGQMVHQAISPRTLNAWVKVIEEKAFSPEVIPMFSALSEGATPQDLNTMLNTVGGHQAAMQMLKDTINEEAAEWDRLHPVHAGPIPPGQMREPRGSDIAGTTSTLQEQIAWMTSNPPIPVGEIYKRWIILGLNKIVRMYSPVSILDIRQGPKEPFRDYVDRFFKTLRAEQATQDVKNWMTDTLLVQNANPDCKTILKALGPGATLEEMMTACQGVGGPSHKARVLAEAMSQVTNAAIMMQRGNFKGQRRIIKCFNCGKEGHIARNCRAPRKKGCWKCGKEGHQMKDCTERQANFLGKIWPSNKGRPGNFLQSRPEPTAPPAESFGFGEEITPSPKQEPKDKEPPLASLKSLFGNDPLSQ

SEQ ID NO: 199 - DNA, 1527 bp, Artificial Sequence
  Description of Artificial Sequnce: Synthetic polynucleotide
ctcgagaagaaaatggcggctcgcgcctcggtcctcagcgggggcaagttggatgcgtgggagaagatccgcttgaggccaggagggaagaagaagtaccggctcaagcacctggtctgggcgagcagggagctggagcgcttcgcgctgaacccgggcctgctggagacatccgagggctgtcagcagatcatcgggcagcttcagccagcgctccagacgggcagcgaggagctgcgctcgctatacaacacggtagcgaccctctactgcgtgcaccagcggatcgaggtcaaggacacgaaggaggctcttgagaagatcgaggaggagcagaacaagtcgcagcagaagacccagcaggcggcggccgacaagggcaactcctcaaaagtatctcagaactacccgatcgtgcagaacctgcagggacagatggtccaccaggccatcagcccacggacgcttaacgcctgggtcaaggtgatcgaggagaaggccttctcgccggaggtcatccccatgttctcggcactctccgagggagccaccccgcaggacctgaacacgatgttgaacacggtcggcgggcaccaggcggccatgcagatgctcaaggataccatcaacgaggaggctgcggagtgggaccgcctgcacccagtgcacgcggggcccatccccccgggccagatgagagagccgcggggatcggacatcgcgggcacgaccagcaccttgcaggagcaaatcgcctggatgactagcaaccccccgatcccggtcggggagatctacaagcggtggatcatcctcgggttgaacaagatcgtgcggatgtacagccctgtctcaatcctggacatccggcaggggcccaaggagcccttccgcgactacgtcgaccggttcttcaagactctccgggcggagcaggcgacgcaggacgtcaagaactggatgacggacaccttgttggtccagaacgctaacccggactgcaagacgatcctgaaggctctcggcccgggagcgaccttggaggagatgatgaccgcgtgccagggggtcgggggacccagccacaaggcgcgggtcttggccgaggcgatgtcccaggtcacgaacgccgcgatcatgatgcagcgggggaacttcaagggccagcgccggatcatcaagtgcttcaactgcggcaaggagggccacatcgcccggaactgccgggccccgcggaagaagggctgctggaagtgcggaaaggaggggcaccagatgaaggactgcacggagcgccaggcgaatttcctcgggaagatctggccgtccaacaaggggcggccagggaacttcctgcaatcgcggccagagccgacggcccctcccgcggagagcttcgggttcggcgaggagatcacgcccagccccaagcaagagccgaaggacaaggagccgccccttgcgtccctcaagtcgctcttcggcaacgacccgctctcccaatgataagctagcggatcctgatca

SEQ ID NO: 200 - DNA, 4823 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgagaagaaaatggcggctcgcgcctcggtcctcagcgggggcaagttggatgcgtgggagaagatccgcttgaggccaggagggaagaagaagtaccggctcaagcacctggtctgggcgagcagggagctggagcgcttcgcgctgaacccgggcctgctggagacatccgagggctgtcagcagatcatcgggcagcttcagccagcgctccagacgggcagcgaggagctgcgctcgctatacaacacggtagcgaccctctactgcgtgcaccagcggatcgaggtcaaggacacgaaggaggctcttgagaagatcgaggaggagcagaacaagtcgcagcagaagacccagcaggcggcggccgacaagggcaactcctcaaaagtatctcagaactacccgatcgtgcagaacctgcagggacagatggtccaccaggccatcagcccacggacgcttaacgcctgggtcaaggtgatcgaggagaaggccttctcgccggaggtcatccccatgttctcggcactctccgagggagccaccccgcaggacctgaacacgatgttgaacacggtcggcgggcaccaggcggccatgcagatgctcaaggataccatcaacgaggaggctgcggagtgggaccgcctgcacccagtgcacgcggggcccatccccccgggccagatgagagagccgcggggatcggacatcgcgggcacgaccagcaccttgcaggagcaaatcgcctggatgactagcaaccccccgatcccggtcggggagatctacaagcggtggatcatcctcgggttgaacaagatcgtgcggatgtacagccctgtctcaatcctggacatccggcaggggcccaaggagcccttccgcgactacgtcgaccggttcttcaagactctccgggcggagcaggcgacgcaggacgtcaagaactggatgacggacaccttgttggtccagaacgctaacccggactgcaagacgatcctgaaggctctcggcccgggagcgaccttggaggagatgatgaccgcgtgccagggggtcgggggacccagccacaaggcgcgggtcttggccgaggcgatgtcccaggtcacgaacgccgcgatcatgatgcagcgggggaacttcaagggccagcgccggatcatcaagtgcttcaactgcggcaaggagggccacatcgcccggaactgccgggccccgcggaagaagggctgctggaagtgcggaaaggaggggcaccagatgaaggactgcacggagcgccaggcgaatttcctcgggaagatctggccgtccaacaaggggcggccagggaacttcctgcaatcgcggccagagccgacggcccctcccgcggagagcttcgggttcggcgaggagatcacgcccagccccaagcaagagccgaaggacaaggagccgccccttgcgtccctcaagtcgctcttcggcaacgacccgctctcccaatgataagctagcggatcctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 201 - protein, 494 aa, Human immunodeficiency virus 1; identical to SEQ ID NO: 173

SEQ ID NO: 202 - DNA, 1526 bp, Human immunodeficiency virus 1
ctcgacaagaaaatggcggcgcgcgcctcggtccttagcgggggcgagttggatcggtgggaaaagatccgcttgaggccaggagggaagaagaagtacaagctcaagcacatcgtctgggcgagcagagagctcgagcggttcgcggtcaacccgggcctgcttgagacatcggagggctgtcggcaaatcctggggcagcttcaaccgtccttgcaaacgggcagcgaggagctgcgatcgctatacaacacggtagcggtcctctactgcgtgcaccagcggatcgacgtcaaggacacgaaggaggctcttgagaagattgaggaagagcagaacaagtcgcagcagaagacgcagcaggcgaaggccgcagacggcaaagtatctcagaactacccgatcgtgcagaacgcgcagggacagatggtccaccaggccatctccccacggacgcttaacgcctgggtcaaagtaatcgaggagaagggattcagcccggaagtgatccccatgttctcggcacttgcggagggagccaccccgcaggacctgaacacgatgttgaacaccatcggcgggcaccaggcggccatgcagatgcttaaggacaccatcaacgacgaggctgcggagtgggaccggcttcacccggtgcaggcggggcccgtcgcgccgggccagatcagagagccgcggggatcggacatcgcgggaaccaccagcaacttgcaggagcaaatcgggtggatgacttcgaaccccccgatcccggtcggggacatctacaagagatggatcatcatggggttgaacaagatcgtgaggatgtacagcccgaccagcatcctggacatccgacagggaccgaaggagtcgttcagagactacgtagaccggttcttccggactctccgggcggagcaggcgtcgcaggaggtcaagaactggatgacggagaccttgttggtccagaactcgaacccggactgcaagaccatcctgaaggctctcggcccggcggcgacgttggaagagatgatgacggcgtgccagggagtcgggggacccggccacaaggcgcgggtcttggccgaggcgatgagccaggtgcagcagccgaacatcatgatgcagcggggcaacttcaagggacagaagcggatcaagtgtttcaactgtggcagggagggacacctcgccaggaactgccgggccccgcggaagaagggctgctggaagtgcggaagggaggggcaccaaatgaaggactgcacggagtcgaaggcgaatttcctcgggaagatctggccgtccaacaaggggcggccagggaactttctgcaaagccggccggagccgtcggccccgccggcggagtcctttgggttcggggaggagatcacgccctcgcagaagcaagagcaaaaggacaaggagctctaccctcttgcgtccctcaagtcgctcttcggcaacgacccgctttcgcaatgataagctagcggatcctgatcaggcgcgcc

SEQ ID NO: 203 - DNA, 4836 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgacaagaaaatggcggcgcgcgcctcggtccttagcgggggcgagttggatcggtgggaaaagatccgcttgaggccaggagggaagaagaagtacaagctcaagcacatcgtctgggcgagcagagagctcgagcggttcgcggtcaacccgggcctgcttgagacatcggagggctgtcggcaaatcctggggcagcttcaaccgtccttgcaaacgggcagcgaggagctgcgatcgctatacaacacggtagcggtcctctactgcgtgcaccagcggatcgacgtcaaggacacgaaggaggctcttgagaagattgaggaagagcagaacaagtcgcagcagaagacgcagcaggcgaaggccgcagacggcaaagtatctcagaactacccgatcgtgcagaacgcgcagggacagatggtccaccaggccatctccccacggacgcttaacgcctgggtcaaagtaatcgaggagaagggattcagcccggaagtgatccccatgttctcggcacttgcggagggagccaccccgcaggacctgaacacgatgttgaacaccatcggcgggcaccaggcggccatgcagatgcttaaggacaccatcaacgacgaggctgcggagtgggaccggcttcacccggtgcaggcggggcccgtcgcgccgggccagatcagagagccgcggggatcggacatcgcgggaaccaccagcaacttgcaggagcaaatcgggtggatgacttcgaaccccccgatcccggtcggggacatctacaagagatggatcatcatggggttgaacaagatcgtgaggatgtacagcccgaccagcatcctggacatccgacagggaccgaaggagtcgttcagagactacgtagaccggttcttccggactctccgggcggagcaggcgtcgcaggaggtcaagaactggatgacggagaccttgttggtccagaactcgaacccggactgcaagaccatcctgaaggctctcggcccggcggcgacgttggaagagatgatgacggcgtgccagggagtcgggggacccggccacaaggcgcgggtcttggccgaggcgatgagccaggtgcagcagccgaacatcatgatgcagcggggcaacttcaagggacagaagcggatcaagtgtttcaactgtggcagggagggacacctcgccaggaactgccgggccccgcggaagaagggctgctggaagtgcggaagggaggggcaccaaatgaaggactgcacggagtcgaaggcgaatttcctcgggaagatctggccgtccaacaaggggcggccagggaactttctgcaaagccggccggagccgtcggccccgccggcggagtcctttgggttcggggaggagatcacgccctcgcagaagcaagagcaaaaggacaaggagctctaccctcttgcgtccctcaagtcgctcttcggcaacgacccgctttcgcaatgataagctagcggatcctgatcaggcgcgccgagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 204 - DNA, 12 bp, Human immunodeficiency virus 1
  modified_base (4)..(9): a, c, t, g, unknown or other
ccannnnnntgg

SEQ ID NO: 205 - protein, 499 aa, Human immunodeficiency virus 1; identical to SEQ ID NO: 174

SEQ ID NO: 206 - DNA, 1535 bp, Human immunodeficiency virus 1
gtcgagaagaaaatggcggctcgcgcctcggtccttagcgggggcaagttggatgcgtgggaaaagatccgcttgaggccaggagggaagaagaagtaccggctcaagcaccttgtctgggcgagcagagagctcgaccggttcgcgctgaacccgtcgctgcttgagacagccgagggctgcaagcaaatcatgaagcagcttcaaccggcgttgaagacgggcacggaggagctgaagtcgctatacaacacggtagcgacgctctactgcgtgcacgagaagatcgacgtcagggacacgaaggaggctcttgacaagattgaggaagagcagaacaagatccagcagaagacgcagcaggcgaaggaggcagacggcaaagtatctcagaactacccgatcgtgcagaacatccagggacagatggtccaccagccgatctccccacggacgcttaacgcctgggtcaaagtagtcgaggagaaggcattcagcccggaagtgatccccatgttcactgcacttagcgacggagccaccccgcaggacctgaacagcatgttgaacgccgtcggcgggcaccaggcggccatgcagatccttaaggacaccatcaacgaggaggctgcggactgggaccggcttcacccggtgcacgcggggcccgtcgcgccgggccagatgagagagccgcggggatcggacatcgcgggaaccaccagcaccttgcaggagcaaatcgggtggatgactaacaaccccccgatcccggtcggggagatctacaagagatggatcatcctggggttgaacaagatcgtgaggatgtacagcccagtcagcatcctggacatcaagcagggaccgaaggagtcgttcagagactacgtcgaccggttcttcaaagtcctccgggcggagcaggcgacgcaggacgtcaagaactggatgacggacaccttgttgatccagaacgcgaacccggactgcaagtcgatcctgcgggctctcggcccgggagcgacgttggaagagatgatgacggcgtgccagggagtcgggggaccctcgcacaaggcgcggatcttggccgaggcgatgtcacaagtgactaacagcgcgaccatcatgatgcagcggggcaacttccggaaccagcggaagacggtgaagtgtttcaactgtggcaaggagggacacctcgccaggaactgcaaggccccgcggaagcggggctgctggaagtgcggaaaggaggggcaccaaatgaaggagtgcacggagcggcaggcgaatttcctcgggaagatctggccgtcctcgaaggggcggccagggaactttccgcaaagccggccggagccgacggccccgccggaggagtcctttcggttcggggaggagacgaccacgccctcgcagaagcaagagccgatcgacaaggagctctaccctcttgcgtccctccggtcgctcttcggcaacgacccgtcgtcgcaagcgtcgtgataagctagcggatccggcgcgcc

SEQ ID NO: 207 - DNA, 4816 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgagaagaaaatggcggctcgcgcctcggtccttagcgggggcaagttggatgcgtgggaaaagatccgcttgaggccaggagggaagaagaagtaccggctcaagcaccttgtctgggcgagcagagagctcgaccggttcgcgctgaacccgtcgctgcttgagacagccgagggctgcaagcaaatcatgaagcagcttcaaccggcgttgaagacgggcacggaggagctgaagtcgctatacaacacggtagcgacgctctactgcgtgcacgagaagatcgacgtcagggacacgaaggaggctcttgacaagattgaggaagagcagaacaagatccagcagaagacgcagcaggcgaaggaggcagacggcaaagtatctcagaactacccgatcgtgcagaacatccagggacagatggtccaccagccgatctccccacggacgcttaacgcctgggtcaaagtagtcgaggagaaggcattcagcccggaagtgatccccatgttcactgcacttagcgacggagccaccccgcaggacctgaacagcatgttgaacgccgtcggcgggcaccaggcggccatgcagatccttaaggacaccatcaacgaggaggctgcggactgggaccggcttcacccggtgcacgcggggcccgtcgcgccgggccagatgagagagccgcggggatcggacatcgcgggaaccaccagcaccttgcaggagcaaatcgggtggatgactaacaaccccccgatcccggtcggggagatctacaagagatggatcatcctggggttgaacaagatcgtgaggatgtacagcccagtcagcatcctggacatcaagcagggaccgaaggagtcgttcagagactacgtcgaccggttcttcaaagtcctccgggcggagcaggcgacgcaggacgtcaagaactggatgacggacaccttgttgatccagaacgcgaacccggactgcaagtcgatcctgcgggctctcggcccgggagcgacgttggaagagatgatgacggcgtgccagggagtcgggggaccctcgcacaaggcgcggatcttggccgaggcgatgtcacaagtgactaacagcgcgaccatcatgatgcagcggggcaacttccggaaccagcggaagacggtgaagtgtttcaactgtggcaaggagggacacctcgccaggaactgcaaggccccgcggaagcggggctgctggaagtgcggaaaggaggggcaccaaatgaaggagtgcacggagcggcaggcgaatttcctcgggaagatctggccgtcctcgaaggggcggccagggaactttccgcaaagccggccggagccgacggccccgccggaggagtcctttcggttcggggaggagacgaccacgccctcgcagaagcaagagccgatcgacaaggagctctaccctcttgcgtccctccggtcgctcttcggcaacgacccgtcgtcgcaagcgtcgtgataagctagcggatccggcgcgccgagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 208 - DNA, 29 bp, Artificial Sequence
  Description of Artificial Sequnce: Synthetic primer
gggcgcctcgagaagaaaatggcggctcg

SEQ ID NO: 209 - protein, 502 aa, Human immunodeficiency virus 1; identical to SEQ ID NO: 175

SEQ ID NO: 210 - DNA, 1543 bp, Human immunodeficiency virus 1
gtcgagaagaaaatggcggctcgcgcctcgatccttcgagggggcaagttggataagtgggaaaagatccgcttgaggccaggagggaagaagagatacatgctcaagcacctgatctgggcgagcagagagctggagcggttcgcgctgaacccgggcctgcttgagacagcggagggctgtcagcaaatcatcgagcagcttcaaagcacgctgaagacgggcagcgaggagctgaagtcgctattcaacacggtagcgaccctctactgcgtgcaccagcggatcgaggtcaaggacacgaaggaggctcttgacaaggtggaggaagagcagaacaagtcgaagaagaaggcgcagcaggcggcggccgacaccggcaactcctcacaagtatctcagaactacccgatcgtgcagaacctgcagggacagatggtccaccaggccctctccccacggacgcttaacgcctgggtcaaagtaatcgaggagaaggccttcagcccggaaatcatccccatgttcacagcactttccgagggagccaccccgagcgacctgaacacgatgttgaacaccgtcggcgggcaccaggcggccatgcagatgcttaaggacaccatcaacgaggaggctgcggagtgggaccgggtgcacccggtgcacgcggggcccatcccaccgggccagatgagagagccgcggggatcggacatcgcgggaaccaccagcagcttgcaggagcaaatcgcctggatgacttcgaaccccccggtcccggtcggggagatctacaagagatggatcgtcctcgggttgaacaagatcgtgaggatgtacagccctgtgtcaatcctggacatccgacagggaccgaaggagcccttcagagactacgtcgaccggttcttcaagactctccgggcggagcaggcgtcgcaggacgtcaagaactggatgacggagaccttgttggtccagaacgctaacccggactgcaagaccatcctgcgcgctctcggcccgggagcgtccttggaagagatgatgacggcgtgccagggagtcgggggaccctcacacaaggcgcgggtcttggccgaggcgatgagccagacgaactccgccatcctcatgcagcggtccaacttcaagggaagcaagcggatcgtcaagtgtttcaactgtggcaaggagggacacatcgccaggaactgccgggccccgcggaagcgaggctgctggaagtgcggacaggaggggcaccaaatgaaggactgcaacgagcgccaggcgaatttcctcgggaagatctggccgtcccacaaggggcggccagggaacttccttcaaaaccggccagagccgacggcccctcccgagccgaccgccccgccggcggagtcctttcgcttcgaggagaccacgcccgcccccaagcaagagctcaaggaccgcgagcctcttacctccctcaagtcgctcttcggctccgacccgctttcgcaagcgtcgtgataagctagcggatccggcgcgc

SEQ ID NO: 211 - DNA, 4824 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgagaagaaaatggcggctcgcgcctcgatccttcgagggggcaagttggataagtgggaaaagatccgcttgaggccaggagggaagaagagatacatgctcaagcacctgatctgggcgagcagagagctggagcggttcgcgctgaacccgggcctgcttgagacagcggagggctgtcagcaaatcatcgagcagcttcaaagcacgctgaagacgggcagcgaggagctgaagtcgctattcaacacggtagcgaccctctactgcgtgcaccagcggatcgaggtcaaggacacgaaggaggctcttgacaaggtggaggaagagcagaacaagtcgaagaagaaggcgcagcaggcggcggccgacaccggcaactcctcacaagtatctcagaactacccgatcgtgcagaacctgcagggacagatggtccaccaggccctctccccacggacgcttaacgcctgggtcaaagtaatcgaggagaaggccttcagcccggaaatcatccccatgttcacagcactttccgagggagccaccccgagcgacctgaacacgatgttgaacaccgtcggcgggcaccaggcggccatgcagatgcttaaggacaccatcaacgaggaggctgcggagtgggaccgggtgcacccggtgcacgcggggcccatcccaccgggccagatgagagagccgcggggatcggacatcgcgggaaccaccagcagcttgcaggagcaaatcgcctggatgacttcgaaccccccggtcccggtcggggagatctacaagagatggatcgtcctcgggttgaacaagatcgtgaggatgtacagccctgtgtcaatcctggacatccgacagggaccgaaggagcccttcagagactacgtcgaccggttcttcaagactctccgggcggagcaggcgtcgcaggacgtcaagaactggatgacggagaccttgttggtccagaacgctaacccggactgcaagaccatcctgcgcgctctcggcccgggagcgtccttggaagagatgatgacggcgtgccagggagtcgggggaccctcacacaaggcgcgggtcttggccgaggcgatgagccagacgaactccgccatcctcatgcagcggtccaacttcaagggaagcaagcggatcgtcaagtgtttcaactgtggcaaggagggacacatcgccaggaactgccgggccccgcggaagcgaggctgctggaagtgcggacaggaggggcaccaaatgaaggactgcaacgagcgccaggcgaatttcctcgggaagatctggccgtcccacaaggggcggccagggaacttccttcaaaaccggccagagccgacggcccctcccgagccgaccgccccgccggcggagtcctttcgcttcgaggagaccacgcccgcccccaagcaagagctcaaggaccgcgagcctcttacctccctcaagtcgctcttcggctccgacccgctttcgcaagcgtcgtgataagctagcggatccggcgcgcgagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 212 - protein, 504 aa, Human immunodeficiency virus 1; identical to SEQ ID NO: 176

SEQ ID NO: 213 - DNA, 1550 bp, Human immunodeficiency virus 1
gtcgagaagaaaatggcggctcgcgcctcggtccttcgaggggagaagttggataagtgggaacggatccgcttgaggccaggagggaagaagcactacatgctcaagcacctggtctgggcgagcagagagctggagaagttcgcgctgaacccgggcctgcttgagacatccgagggctgtaagcaaatcatcaagcagcttcaaccagcgctccagacgggcaccgaggagctgcgctcgctattcaacacggtagcgaccctctactgcgtgcacgccggaatcgaagttcgtgacacgaaggaggctcttgacaagatcgaggaaatccagaacaagtcgaagcagaagacccagcaggcggcggccgggaccggctcgtcctcaaaagtatctcagaactacccgatcgtgcagaacctgcagggacagatggtccaccagccgctctccccacggacgcttaacgcctgggtcaaagtagtcgaggagaaggggttcaacccggaagtcatccccatgttctcggcactttccgagggagccaccccgcaggacctgaacatgatgttgaacatcgtcggcgggcaccaggcggccatgcagatgcttaaggagaccatcaacgaggaggctgcggagtgggaccgcctgcacccggtgcacgcggggcccatcgcaccgggccagatgagagagccgcggggatcggacatcgcgggatccaccagcaccttgcaggagcaaatcgcctggatgactgggaaccccccggtcccggtcggggacatctacaagagatggatcatcctcgggttgaacaagatcgtgaagatgtacagccctacgtcaatcctggacatcaagcagggccccaaggagcccttcagagactacgtcgaccggttctacaagactctccgggcggagcaggcgacgcaggaggtcaagaactggatgacggacaccttgttggtccagaacgctaacccggactgcaagagcatcctgaaggctctcggcacgggagcgaccttggaagagatgatgtccgcgtgccagggagtcgggggacccgcgcacaaggcgcgggtcttggccgaggcgatgtcccaggccaacaacacgaacatcatgatgcagcggtccaacttcaagggaccgaagcggatcatcaagtgtttcaactgtggcaaggagggacacatcgccaagaactgccgggccccgcggaagaagggctgctggaagtgcggaaaggaggggcaccaaatgaaggactgcacggagcgccaggcgaatttcctcgggcggatctggccgtcctcgaaggggcggccagggaacttccttcaatcgcggccagagccgacggcccctcccgcggagccgaccgccccgccggcggagtcctttaagttcgaggagaccacgcccgcccccaagcaagagccgaaggaccgcgagcctcttacctccctccggtcgctcttcggctccgacccgcttctgcaagcgtcgtgataagctagcggatccggcgcgcc

SEQ ID NO: 214 - DNA, 4831 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgagaagaaaatggcggctcgcgcctcggtccttcgaggggagaagttggataagtgggaacggatccgcttgaggccaggagggaagaagcactacatgctcaagcacctggtctgggcgagcagagagctggagaagttcgcgctgaacccgggcctgcttgagacatccgagggctgtaagcaaatcatcaagcagcttcaaccagcgctccagacgggcaccgaggagctgcgctcgctattcaacacggtagcgaccctctactgcgtgcacgccggaatcgaagttcgtgacacgaaggaggctcttgacaagatcgaggaaatccagaacaagtcgaagcagaagacccagcaggcggcggccgggaccggctcgtcctcaaaagtatctcagaactacccgatcgtgcagaacctgcagggacagatggtccaccagccgctctccccacggacgcttaacgcctgggtcaaagtagtcgaggagaaggggttcaacccggaagtcatccccatgttctcggcactttccgagggagccaccccgcaggacctgaacatgatgttgaacatcgtcggcgggcaccaggcggccatgcagatgcttaaggagaccatcaacgaggaggctgcggagtgggaccgcctgcacccggtgcacgcggggcccatcgcaccgggccagatgagagagccgcggggatcggacatcgcgggatccaccagcaccttgcaggagcaaatcgcctggatgactgggaaccccccggtcccggtcggggacatctacaagagatggatcatcctcgggttgaacaagatcgtgaagatgtacagccctacgtcaatcctggacatcaagcagggccccaaggagcccttcagagactacgtcgaccggttctacaagactctccgggcggagcaggcgacgcaggaggtcaagaactggatgacggacaccttgttggtccagaacgctaacccggactgcaagagcatcctgaaggctctcggcacgggagcgaccttggaagagatgatgtccgcgtgccagggagtcgggggacccgcgcacaaggcgcgggtcttggccgaggcgatgtcccaggccaacaacacgaacatcatgatgcagcggtccaacttcaagggaccgaagcggatcatcaagtgtttcaactgtggcaaggagggacacatcgccaagaactgccgggccccgcggaagaagggctgctggaagtgcggaaaggaggggcaccaaatgaaggactgcacggagcgccaggcgaatttcctcgggcggatctggccgtcctcgaaggggcggccagggaacttccttcaatcgcggccagagccgacggcccctcccgcggagccgaccgccccgccggcggagtcctttaagttcgaggagaccacgcccgcccccaagcaagagccgaaggaccgcgagcctcttacctccctccggtcgctcttcggctccgacccgcttctgcaagcgtcgtgataagctagcggatccggcgcgccgagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 215 - DNA, 21 bp, Artificial Sequence
  Description of Artificial Sequnce: Synthetic primer
ccgccccattgacgcaaatgg

SEQ ID NO: 216 - DNA, 21 bp, Artificial Sequence
  Description of Artificial Sequnce: Synthetic primer
gctggcaactagaaggcacag

SEQ ID NO: 217 - DNA, 21 bp, Artificial Sequence
  Description of Artificial Sequnce: Synthetic primer
cgaccgttgatcttccgtgtc

SEQ ID NO: 218 - DNA, 3325 bp, Human immunodeficiency virus 1
aaatgggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgcgttcaaaatggtatgcgttttgacacatccactatatatccgtgtcgttctgtccactcctgaatcccattccagaaattctctagcgattccagaagtttctcagagtcggaaagttgaccagacattacgaactggcacagatggtcataacctgaaggaagatctgattgcttaactgcttcagttaagaccgacgcgctcgtcgtataacagatgcgatgatgcagaccaatcaacatggcacctgccattgctacctgtacagtcaaggatggtagaaatgttgtcggtccttgcacacgaatattacgccatttgcctgcatattcaaacagctcttctacgataagggcacaaatcgcatcgtggaacgtttgggcttctaccgatttagcagtttgatacactttctctaagtatccacctgaatcataaatcggcaaaatagagaaaaattgaccatgtgtaagcggccaatctgattccacctgagatgcataatctagtagaatctcttcgctatcaaaattcacttccaccttccactcaccggttgtccattcatggctgaactctgcttcctctgttgacatgacacacatcatctcaatatccgaatacggaccatcagtctgacgaccaagagagccataaacaccaatagccttaacatcatccccatatttatccaatattcgttccttaatttcatgaacaatcttcattctttcttctctagtcattattattggtccgttcataacaccccttgtattactgtttatgtaagcagacagttttattgttcatgatgatatatttttatcttgtgcaatgtaacatcagagattttgagacacaacgtggctttccccggcccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatagccgcggcatcgatgatatccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacgggcgacgcgaaacttgggcccactcgagaggcgcgccgagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggaattt

SEQ ID NO: 219 - protein, 852 aa, Artificial Sequence
  Description of Artificial Sequnce: Synthetic polypeptide
MRVRGIQRNCQHLWRWGTLILGMLMICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTNVNVTNTTNNTEEKGEIKNCSFNITTEIRDKKQKVYALFYRLDVVPIDDNNNNSSNYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISGTKWNKTLQQVAKKLREHFNNKTIIFKPSSGGDLEITTHSFNCRGEFFYCNTSGLFNSTWIGNGTKNNNNTNDTITLPCRIKQIINMWQGVGQAMYAPPIEGKITCKSNITGLLLTRDGGNNNTNETEIFRPGGGDMRDNWRSELYKYKVVKIEPLGVAPTKAKRRVVEREKRAVGIGAVFLGFLGAAGSTMGAASITLTVQARQLLSGIVQQQSNLLRAIEAQQHLLQLTVWGIKQLQARVLAVERYLKDQQLLGIWGCSGKLICTTTVPWNSSWSNKSQDEIWDNMTWMEWEREINNYTDIIYSLIEESQNQQEKNEQELLALDKWASLWNWFDITNWLWYIKIFIMIVGGLIGLRIVFAVLSIVNRVRQGYSPLSFQTLIPNPRGPDRPEGIEEEGGEQDRDRSIRLVNGFLALAWDDLRSLCLFSYHRLRDFILIAARTVELLGRKGLRRGWEALKYLWNLLQYWGQELKNSAISLLDTTAIAVAEGTDRVIEVVQRACRAILNIPRRIRQGLERALL

SEQ ID NO: 220 - protein, 849 aa, Artificial Sequence; identical to SEQ ID NO: 178
  Description of Artificial Sequnce: Synthetic polypeptide

SEQ ID NO: 221 - protein, 861 aa, Artificial Sequence
  Description of Artificial Sequnce: Synthetic polypeptide
MRVTEIRKNYLWRWGIMLLGMLMICSAAEQLWVTVYYGVPVWKEATTTLFCASDAKAYTAEAHNVWATHACVPTDPNPQEVVLENVTENFNMWKNNMVEQMHEDIISLWDQSLKPCVKLTPLCVTLNCTDLANNTNLANNTNSSISSWEKMEKGEIKNCSFNITTVIKDKIQKNYALFNRLDIVPIDDDDTNVTNNASYRLISCNTSVITQACPKISFEPIPIHYCAPAGFAILKCNDKKFNGTGPCTNVSTVQCTHGIKPVVSTQLLLNGSLAEEEVVIRSENFTDNVKTIIVQLNESVIINCTRPNNNTRKSITFGPGRAFYTTGDIIGDIRKAYCNISSTQWNNTLRQIARRLREQFKDKTIVFNSSSGGDPEIVMHSFNCGGEFFYCNTTQLFNSTWNGNDTGEFNNTGKNITYITLPCRIKQIINMWQEVGKAMYAPPIAGQIRCSSNITGILLTRDGGNSSEDKEIFRPEGGNMRDNWRSELYKYKVVKIEPLGVAPTKAKRRVVQREKRAVGIGAVFLGFLGAAGSTMGAASMTLTVQARLLLSGIVQQQNNLLRAIEAQQHLLQLTVWGIKQLQARVLAVERYLKDQQLLGIWGCSGKLICTTAVPWNASWSNRSLDNIWNNMTWMEWDREINNYTNLIYNLIEESQNQQEKNEQELLELDKWASLWNWFDITKWLWYIKIFIMIVGGLVGLRIVFVILSIVNRVRQGYSPLSFQTHLPTPRGLDRHEGTEEEGGERDRDRSGRLVDGFLTLIWIDLRSLCLFSYHRLRDLLLIVTRIVELLGRRGWEILKYWWNLLQYWSQELKNSAVSLLNATAIAVAEGTDRIIEIVQRIFRAILHIPTRIRQGLERALL

SEQ ID NO: 222 - protein, 859 aa, Artificial Sequence
  Description of Artificial Sequnce: Synthetic polypeptide
MRVRGILRNYQQWWIWGILGFWMLMICSVGGNLWVTVYYGVPVWREAKTTLFCASDAKAYEREVHNVWATHACVPTDPNPQELFLENVTENFNMWKNDMVDQMHEDIISLWDQSLKPCVKLTPLCVTLNCSNANITRNSTDGNTTRNSTATPSDTINGEIKNCSFNITTELKDKKKKEYALFYRLDIVPLNEENSNFNEYRLINCNTSAVTQACPKVSFDPIPIHYCAPAGYAILKCNNKTFNGTGPCNNVSTVQCTHGIKPVVSTQLLLNGSLAEEEIIIRSENLTNNAKTIIVHLKEPVEIVCTRPNNNTRKSMRIGPGQTFYATDIIGDIRQASCNIDEKTWNNTLNKVGEKLQEHFPNKTLNFAPSSGGDLEITTHSFNCRGEFFYCNTSKLFYKTEFNSTTNSTITLQCRIKQIINMWQGVGRAMYAPPIEGNITCKSNITGLLLTRDGGTNDSMTETFRPGGGDMRDNWRSELYKYKVVEIKPLGVAPTEAKRRVVEREKRALTLGALFLGFLGTAGSTMGAASITLTVQARQLLSGIVQQQSNLLKAIEAQQHLLQLTVWGIKQLQTRVLAIERYLQDQQLLGLWGCSGKLICTTAVPWNSSWSNKSQGEIWGNMTWMQWDREISNYTNTIYRLLEDSQIQQEKNEKDLLALDSWKNLWSWFSITNWLWYIKIFIMIVGGLIGLRIIFAVLSIVNRVRQGYSPLPFQTLIPNPRGPDRLGRIEEEGGEQDRDRSIRLVNGFLAIAWDDLRSLCLFSYHRLRDFILIAARAAELLGRSSLRGLQRGWEALKYLGSLVQYWGLELKKSAISLLDTVAITVAEGTDRIIEVVQRICRAICNIPRRIRQGFEAALQ

What is claimed is:

1. An isolated and purified mosaic clade M human immunodeficiency virus type 1 (HIV-1) Env polypeptide comprising an amino acid sequence selected from the group consisting of M_mos_Env_3_1 (SEQ ID NO:177), M_mos_Env_3_2 (SEQ ID NO:178) and M_mos_Env_3_3 (SEQ ID NO:179).

2. The polypeptide according to claim 1 wherein said polypeptide comprises the amino acid of SEQ ID NO:177.

3. The polypeptide according to claim 1 wherein said polypeptide comprises the amino acid of SEQ ID NO:178.

4. The polypeptide according to claim 1 wherein said polypeptide comprises the amino acid of SEQ ID NO:179.

5. A composition comprising the polypeptide according to claim 1 and a carrier.

6. A method of inducing an immune response against HIV-1 in a host comprising administering to said host an amount of the polypeptide according to claim 1 sufficient to induce said response.

* * * * *